(12) United States Patent
Schirmer et al.

(10) Patent No.: US 10,787,648 B2
(45) Date of Patent: Sep. 29, 2020

(54) OMEGA-HYDROXYLASE-RELATED FUSION POLYPEPTIDE VARIANTS WITH IMPROVED PROPERTIES

(71) Applicant: GENOMATICA, INC., San Diego, CA (US)

(72) Inventors: Andreas Schirmer, Hayward, CA (US); Baolong Zhu, Emeryville, CA (US); Emanuela Popova, Dublin, CA (US)

(73) Assignee: GENOMATICA, INC., San Diego, CA (US)

( * ) Notice: Subject to any disclaimer, the term of this patent is extended or adjusted under 35 U.S.C. 154(b) by 0 days.

(21) Appl. No.: 16/063,198

(22) PCT Filed: Dec. 13, 2016

(86) PCT No.: PCT/US2016/066405
§ 371 (c)(1),
(2) Date: Jun. 15, 2018

(87) PCT Pub. No.: WO2017/106205
PCT Pub. Date: Jun. 22, 2017

(65) Prior Publication Data
US 2019/0002845 A1    Jan. 3, 2019

Related U.S. Application Data

(63) Continuation-in-part of application No. PCT/EP2015/079832, filed on Dec. 15, 2015.

(51) Int. Cl.
| | | |
|---|---|---|
| C12N 9/02 | (2006.01) | |
| C12N 9/04 | (2006.01) | |
| C12N 15/62 | (2006.01) | |
| C12N 15/81 | (2006.01) | |
| C12N 9/18 | (2006.01) | |

(52) U.S. Cl.
CPC ......... *C12N 9/0006* (2013.01); *C12N 9/0042* (2013.01); *C12N 15/62* (2013.01); *C12N 15/81* (2013.01); *C07K 2319/00* (2013.01); *C12N 9/18* (2013.01); *C12Y 101/01* (2013.01); *C12Y 301/01005* (2013.01); *C12Y 301/02014* (2013.01)

(58) Field of Classification Search
CPC ........... C12N 9/02; C12N 15/81; C12N 15/62
USPC .............................. 435/134, 252.3
See application file for complete search history.

(56) References Cited

U.S. PATENT DOCUMENTS

| | | |
|---|---|---|
| 5,000,000 A | 3/1991 | Ingram et al. |
| 5,028,539 A | 7/1991 | Ingram et al. |
| 5,059,532 A | 10/1991 | Kimura et al. |
| 5,424,202 A | 6/1995 | Ingram et al. |
| 5,482,846 A | 1/1996 | Ingram et al. |
| 5,602,030 A | 2/1997 | Ingrahm et al. |
| 5,939,250 A | 8/1999 | Short |
| 5,965,408 A | 10/1999 | Short |
| 7,169,588 B2 | 1/2007 | Burch et al. |
| 7,745,652 B2 | 6/2010 | Lysenko et al. |
| 8,071,799 B2 | 12/2011 | Olson |
| 8,097,439 B2 | 1/2012 | Alibhai et al. |
| 8,110,093 B2 | 2/2012 | Friedman et al. |
| 8,110,670 B2 | 2/2012 | Hu et al. |
| 8,183,028 B2 | 5/2012 | Alibhai et al. |
| 8,232,924 B2 | 7/2012 | Bucca et al. |
| 8,237,003 B2 | 8/2012 | Holtcamp et al. |
| 8,268,599 B2 | 9/2012 | Schirmer et al. |
| 8,273,694 B2 | 9/2012 | Brown et al. |
| 8,283,143 B2 | 10/2012 | Hu et al. |
| 8,299,313 B2 | 10/2012 | Takai et al. |
| 8,313,934 B2 | 11/2012 | Bhatia et al. |
| 8,361,769 B1 | 1/2013 | Koch et al. |
| 8,372,610 B2 | 2/2013 | Lee et al. |
| 8,420,840 B2 | 4/2013 | Olson |
| 8,530,221 B2 | 9/2013 | Hu et al. |
| 8,569,560 B2 | 10/2013 | Schrodi et al. |
| 8,592,188 B2 | 11/2013 | Franklin et al. |
| 2008/0220419 A1 | 9/2008 | Kubota et al. |
| 2008/0293060 A1 | 11/2008 | Schirmer et al. |
| 2009/0140696 A1 | 6/2009 | Okuto |
| 2009/0264672 A1 | 10/2009 | Abraham et al. |
| 2010/0071259 A1 | 3/2010 | Hu et al. |
| 2010/0105955 A1 | 4/2010 | Alibhai et al. |

(Continued)

FOREIGN PATENT DOCUMENTS

| | | |
|---|---|---|
| EP | 2 639 308 A1 | 9/2013 |
| JP | 2009-005687 A | 1/2009 |

(Continued)

OTHER PUBLICATIONS

Preliminary Office Action in BR Patent Application No. 112015031233.0 dated Oct. 29, 2019 (with English translation) (7 pages).
Altschul et al., "Basic Local Alignment Search Tool," Journal of Molecular Biology 215(3): 403-410 (1990).
Altschul et al., "Protein database searches using compositionally adjusted substitution matrices," FEBS J. 272(20): 5101-5109 (2005).
Amann et al., "Tightly regulated tac promoter vectors useful for the expression of unfused and fused proteins in *Escherichia coli*," Gene 69(2): 301-315 (1988).
Arkin et al. "An algorithm for protein engineering: Simulations of recursive ensemble mutagenesis," Proc. Natl. Acad. Sci. USA. 89: 7811-7815 (1992).
Arnold, "Protein engineering for unusual environments," Curr. Opin. Biotech. 4: 450-455 (1993).

(Continued)

*Primary Examiner* — Tekchand Saidha
(74) *Attorney, Agent, or Firm* — Foley & Lardner LLP

(57) ABSTRACT

The disclosure relates to omega-hydroxylase-related fusion polypeptides that result in improved omega-hydroxylated fatty acid derivative production when expressed in recombinant host cells. The disclosure further relates to microorganisms for expressing the omega-hydroxylase-related fusion polypeptides for the production of omega-hydroxylated fatty acid derivatives.

10 Claims, 6 Drawing Sheets

Specification includes a Sequence Listing.

(56) References Cited

U.S. PATENT DOCUMENTS

| | | |
|---|---|---|
| 2010/0105963 A1 | 4/2010 | Hu |
| 2010/0127318 A1 | 5/2010 | Noort et al. |
| 2010/0145086 A1 | 6/2010 | Schrodi et al. |
| 2010/0170826 A1 | 7/2010 | Friedman et al. |
| 2010/0199548 A1 | 8/2010 | Del Cardayre et al. |
| 2010/0216198 A1 | 8/2010 | Dubois |
| 2010/0221798 A1 | 9/2010 | Schirmer et al. |
| 2010/0235934 A1 | 9/2010 | Friedman et al. |
| 2010/0242345 A1 | 9/2010 | Keasling et al. |
| 2010/0249470 A1 | 9/2010 | Schirmer et al. |
| 2010/0251601 A1 | 10/2010 | Hu et al. |
| 2010/0257777 A1 | 10/2010 | Sanchez-Riera et al. |
| 2010/0257778 A1 | 10/2010 | Gaertner et al. |
| 2010/0274033 A1 | 10/2010 | Sanchez-Riera et al. |
| 2011/0072714 A1 | 3/2011 | Gaertner |
| 2012/0070868 A1 | 3/2012 | Lee et al. |
| 2012/0277452 A1 | 11/2012 | Franklin et al. |
| 2012/0289729 A1 | 11/2012 | Holtcamp et al. |
| 2013/0130336 A1 | 5/2013 | Olson |
| 2014/0228586 A1 | 8/2014 | Beardslee et al. |
| 2015/0111253 A1 | 4/2015 | Schaffer et al. |

FOREIGN PATENT DOCUMENTS

| | | |
|---|---|---|
| JP | 2016-519714 | 7/2015 |
| WO | WO-91/16427 | 10/1991 |
| WO | WO-2006/051729 A1 | 5/2006 |
| WO | WO-2007/136762 A2 | 11/2007 |
| WO | WO-2008/119082 A2 | 10/2008 |
| WO | WO-2008/147781 | 12/2008 |
| WO | WO-2010/022090 A1 | 2/2010 |
| WO | WO-2010/062480 A2 | 6/2010 |
| WO | WO-2010/075483 A2 | 7/2010 |
| WO | WO-2010/118409 A1 | 10/2010 |
| WO | WO-2010/127318 | 11/2010 |
| WO | WO-2011/038132 A1 | 3/2011 |
| WO | WO-2011/038134 A1 | 3/2011 |
| WO | WO-2011/062987 | 5/2011 |
| WO | WO-2011/127409 | 10/2011 |
| WO | WO-2012/071439 A1 | 5/2012 |
| WO | WO-2013/024114 A2 | 2/2013 |
| WO | WO-2013/135650 | 9/2013 |
| WO | WO-2014/201474 A1 | 12/2014 |
| WO | WO-2014201474 A1 * | 12/2014 |
| WO | WO-2015195697 A1 * | 12/2015 |

OTHER PUBLICATIONS

Baldari et al., "A novel leader peptide which allows efficient secretion of a fragment of human interleukin 1 beta in *Saccharomyces cerevisiae*," EMBO J. 6(1): 229-234 (1987).
Bieniek et al., "Advanced Fine-Tuning of Grubs/Hoveyda Olefin Metathesis Catalysts: A Further Step toward an Optimum Balance between Antinomic Properties," J. Am. Chem. Soc. vol. 128, 2006, pp. 13652-13653.
Bordeaux et al., "A Regioselective Biocatalyst for Alkane Activation under Mild Conditions," Angewandte Chemie International Edition 50(9): 2075-2079 (2011)(abstract).
Bordeaux et al., "Catalytic, Mold, and Selective Oxyfunctionalization of Linear Alkanes: Current Challenges," Angewandte Chemie International Edition 51(43): 10712-10723 (2012).
Bowie et al., "Deciphering the Message in Protein Sequences: Tolerance to Amino Acid Substitutions," Science, 247: 1306-1310 (1990).
Braun, "Minireviews—FhuA (TonA), the Career of a Protein," J. Bacteriol. 191(11): 3431-3436 (2009).
Cadwell et al., "Randomization of Genes by PCR Mutagenesis," PCR Methods Applic. 2: 28-33 (1992).
Caviglia et al., "Rat Long Chain Acyl-CoA Synthetase 5, but Not 1, 2, 3, or 4, Complements *Escherichia coli* fadD," J. Biol. Chem. 279(12): 11163-11169 (2004).

Clark, "Regulation of Fatty Acid Degration in *Escherichia coli*: Analysis by Operon Fusion," J Bacteriol. 148(2): 521-526 (1981).
Cronan et al., "FadR, transcriptional co-ordination of metabolic expediency," Mole. Microbiol. 29(4):937-943 (1998).
Currie, "Source Apportionment of Atmospheric particles," Characterization of Environmental Particles, vol. 1 of the IUPAC Environmental Analytical Chemistry Series, pp. 3-74 (1992).
De Mot et al., "A novel class of self-sufficient cytochrome P450 monooxygenases in prokaryotes," Trends Microbiol. 10(11): 502-508 (2002).
Delegrave et al., "Searching Sequence Space to Engineer Proteins: Exponential Ensemble Mutagenesis," Biotech. Res, 11: 1548-1552 (1993).
Dietrich et al., "Cloning, expression and characterisation of CYP102A7, a self-sufficient P450 monooxygenase from Bacillus licheniformis," Appl. Microbiol. Biotechnol. 79: 931-940 (2008)(abstract).
Enzyme entry EC 2.3.1.75 (last viewed on Dec. 17, 2014).
Erijman et al., "Transfer-PCR (TPCR): A highway for DNA cloning and protein engineering," J. Structural Bio. 175: 171-177 (2011).
Fasan, R., "Tuning P450 Enzymes as Oxidation Catalysts," ACS Catal., (2012), vol. 2, pp. 647-666.
Final Office Action on U.S. Appl. No. 14/897,285, dated Jan. 19, 2018, 17 pages.
Forman et al., "Metathesis of renewable unsaturated fatty acid esters catalyzed by a phoban-indenylidene ruthenium catalyst," J. Org. Chem (2006, 691, pp. 5513-5516.
Fujita et al., "Comparison of Two Vectors for Functional Expression of a Bacterial Cytochrome P450 Gene in *Escherichia coli* Using CYP153 Genes," Biosci. Biotechnol. Biochem. 43: 1825-1830 (2009).
Funhoff et al., "CYP153A6, a Soluble P450 Oxygenase Catalyzing Terminal-Alkane Hydroxylation," J. Bacteriol. 188(14): 5220-5227 (2006).
Funhoff, E.G. et al., "Hydroxylation and epoxidation reactions catalyzed by CYP153 enzymes" Enzyme Microb. Technol., (2007), vol. 40, pp. 806-812.
Galan et al., "A Rapid and Simple Cleanup Procedure for Metathesis Reactions," Org. Letters (2207, vol. 9, No. 7, pp. 1203-1206.
GenBank, accession No. ABM17701, 2011, www.ncbi.nlm.nih.gov.
GenBank, Accession No. WP_026137860.1, Jun. 8, 2014, www.ncbi.nlm.nih.gov.
Goeddel, "Gene Expression Technology: Methods in Enzymology," vol. 185, Academic Press, San Diego, CA (1990).
Grela et al., "A Highly Efficient Ruthenium Catalyst for Metathesis Reactions," Angew. Chem. Int. Ed, vol. 41, No. 21, 2002, pp. 4038-4040.
Grosjean et al., "Preferential codon usage in prokaryotic genes: the optimal codon-anticodon interaction energy and the selective codon usage in efficiently expressed genes," Gene 18:199-209 (1982).
Guo et al., Protein tolerance to random amino acid change, 2004, Proc. Natl. Acad. Sci. USA 101: 9205-9210.
Hill et al., "Functional Analysis of Conserved Histidines in ADP-Glucose Pyrophosphorylase from *Escherichia coli*," Biochem. Biophys. Res. Comm., 1998, 244, pp. 573-577.
Hong et al., "Prevention of Undesirable Isomerization during Olefin Metathesis," J. Am. Chem Soc. (2005), vol. 127, pp. 17160-17161.
Hunter et al., "Analysis of the domain properties of the novel cytochrome P450 RhF," FEBS Lett. 579: 2215-2220 (2005).
International Preliminary Report on Patentability on PCT/EP2015,079832, dated May 4, 2018, 18 pages.
International Preliminary Report on Patentability on PCT/US2014/042594, dated Dec. 15, 2015, 9 pages.
International Preliminary Report on Patentability on PCT/US2015/036078, dated Jun. 1, 2016, 15 pages.
International Preliminary Report on Patentability on PCT/US2016/066405, dated Jun. 19, 2018, 6 pages.
International Search Report and Written Opinion from Application PCT/US14/042594, dated Oct. 16, 2014.
International Search Report and Written Opinion on PCT/EP2015/079832, dated Sep. 27, 2016, 11 pages.
International Search Report and Written Opinion on PCT/US2014/042594, dated Oct. 16, 2014, 14 pages.

(56) References Cited

OTHER PUBLICATIONS

International Search Report and Written Opinion on PCT/US2015/036078, dated Jan. 11, 2016, 11 pages.
International Search Report and Written Opinion on PCT/US2016/066405, dated Apr. 28,2017, 11 pages.
Knothe, "Dependence of biodiesel fuel properties on the structure of fatty acid alkyl esters," Fuel Processing Technology, 86:1059-1070 (2005).
Kubota et al., "Isolation and Functional Analysis of Cytochrome P450 CYP153A Genes from Various Environments," Biosci Biotechnol. Biochem. 69: 2421-2430 (2005).
Kurjan et al., "Structure of a Yeast Pheromone Gene (MFα): A Putative α-Factor Precursor Contains Four Tandem Mature α-Factor," Cell 30: 933-943 (1982).
Lazar et al., "Transforming Growth Factor alpha: Mutation of Aspartic Acid 4 7 and Leucine 48 Results in Different Biological Activity," Mol. Cell. Biol., vol. 8, pp. 1247-1252.
Lentz et al., "Altering the regioselectivity of cytochrome P450 CYP102A3 of Bacillus subtilis by using a new versatile assay system," Chem Bio Chem 7: 345-350 (2006).
Lentz et al., "Substrate specificity of native and mutated cytochrome P450 (CYP102A3) from Bacillus subtilis," J. Biotechnol. 108(1): 41-49 (2004)(abstract).
Leung et al. "A Journal of Methods in Cell and Molecular Biology," Technique 1:(1): 11-15 (1989).
Luckow et al. "High Level Expression of Nonfused Foreign Genes with Autographa californica Nuclear Polyhedrosis Virus Expression Vectors," (1989) Virology 170, pp. 31-39.
Malca et al., Bacterial CYP153A monooxygenases for the synthesis of omega-hydroxylated fatty acids, Chemcom, vol. 48, Mar. 12, 2012, pp. 5115-5117.
Malca, S.H., "Substrate characterization and protein engineering of bacterial cytochrome P450 monooxygenases for the bio-based synthesis of omega-hydroxy aliphatic compounds," (Jun. 16, 2013), [Retrieved on May 30, 2018], Retrieved from the Internet, URL,http://dx.doi.org/10.18419/opus-1388, 146 pages.
Maniatis et al., "Regulation of Inducible and Tissue-Specific Gene Expression," Science 236: 1237-1245 (1987).
Marvey et al., "The metathesis of polyunsaturated fatty esters using the homogeneous(O-2,6-C6H3X2)2Cl4/Me4Sn catalytic," J. Mol. Cat. A. Chem. (2004, vol. 213, pp. 151-157.
Marvey, "Sunflower-based Feedstocks in Nonfood Applications; perspectives from Olefin Metathesis," International Journal of Molecular Sciences, vol. 9, pp. 1393-1406.
Needleman and Wunsch, "A General Method Applicable to the Search for Similarities in the Amino Acid Sequence of Two Proteins," J. Mol. Biol. 48:443-453 (1970).
Nestl et al., "Recent progress in industrial biocatalysis," Curr. Opin. Chem. Bio. 15(2): 187-193 (2011)(abstract).
Ngo et al. "The Protein Folding Problem and Tertiary Structure Prediction," Birkhauser (1994), pp. 433 and 492-495 (5 pages).
Nicolaides et al., "Metathesis of Fatty Esters Derived from South African Sunflower Oil," JAOCS, vol. 67, No. 6, Jun. 1990, pp. 362-363.
Nodate et al., "Functional expression system for cytochrome P450 genes using the reductase domain of self-sufficient P450RhF gtom Rhodococcus sp. NCIMB 9784," Appl. Microbiol. Biotech. 71(4): 455-462 (2005).
Non-Final Office Action issued on U.S. Appl. No. 13/444,579, dated Dec. 16, 2013.
Non-Final Office Action on U.S. Appl. No. 14/897,285, dated Oct. 23, 2018, 22 pages.
Non-Final Rejection Office Action in U.S. Appl. No. 14/007,829 dated Oct. 27, 2015.
Notice of Allowance on U.S. Appl. No. 13/444,579, dated Jun. 22, 2015.
Notice of Allowance on U.S. Appl. No. 14/897,285 dated Aug. 13, 2019.
Notice of Reasons for Rejection issued on Japanese Application 2016-519714, dated Jun. 11, 2018,28 pages with translation.
Office Action issued on CO 15293885, dated Aug. 10, 2017, 12 pages.
Office Action issued on CO NC2016/0005882, dated Apr. 3, 2018, 6 pages.
Office Action on U.S. Appl. No. 14/897,285, dated Feb. 17, 2017, 10 pages.
Office Action on CN 201480033702.8, dated Aug. 2, 2018, 16 pages with translation.
Office Action on CN 201480033702.8, dated Jul. 1, 2019, 14 pages with translation.
Office Action on CO 15-293.885, dated Feb. 17, 2016, 4 pages.
Office Action on CO 15-293.885, dated dated Jan. 21, 2016, 4 pages.
Office Action on CO NC2016/0005882, dated Aug. 31, 2018, 8 pages.
Office Action on CO NC2016/0005882, dated Jan. 13, 2017, 2 pages.
Office Action on EP 14738962.1, dated Feb. 16, 2017, 5 pages.
Office Action on EP 14738962.1, dated Mar. 6, 2018, 4 pages.
Office Action on EP 14738962.1, dated Sep. 27, 2018, 4 pages.
Office Action on EP 15732504.4, dated Feb. 17, 2017, 4 pages.
Office Action on EP 15732504.4, dated Jul. 31, 2019, 3 pages.
Office Action on EP 15732504.4, dated Sep. 14, 2018, 3 pages.
Office Action on ID P00201600007, dated Aug. 21, 2019, 5 pages with translation.
Office Action on dated 2016-519714, dated Jun. 6, 2019, 29 pages with translation.
Office Action on JP 2016-573541, dated May 16. 2019, 10 pages with translation.
Office action on MX MX/a/2015/016947, dated Aug. 28, 2019, 4 pages.
Office Action on MX MX/a/2016/016565, dated Aug. 6, 2019, 8 pages.
Office action on U.S. Appl. No. 14/897,285, dated May 18, 2017, 20 pages.
Office Action on U.S. Appl. No. 15/319,272, dated Apr. 24, 2019, 7 pages.
Office Action on dated 15/319,272, dated Aug. 10, 2018 10 pages.
Oliver et al., "A Single Mutation in Cytochrome P450 BM3 Changes Substrate Orientation in a Catalytic Intermediate and the Regiospecificity of Hydroxylation," Biochem. 36(7): 1567 (1997) (abstract).
Reidhaar-Olson et al., "Combinatorial Cassette Mutagenesis as a Probe of the Informational Content of Protein Sequences," Science 241: 53-57 (1988).
Roberts et al., "A Self-sufficient Cytochrome P450 with a Primary Structural Organization That Includes a Flavin Domain and a [2Fe—2S] Redox Center," J. Biol. Chem. 278: 48914 (2003).
Rosenberg, "Multiple Sequence Alignment Accuracy and Evolutionary Distance Estimation," BMC Bioinformatics 6: 278 (2005).
Rude et al., "Terminal Olefin (1-Alkene) Biosynthesis by a Novel P450 Fatty Acid Decarboxylase from Jeotgalicoccus Species", Appl. Environ. Microbiol. 77(5): 1718-1727 (2011).
Sambrook et al., "Molecular Cloning: A Laboratory Manual," 1989, 2nd Ed., Cold Spring Harbor Laboratory Press, Cold Spring Harbor, NY.
Scheps et al., "Regioselective omega-hydroxylation of medium-chain n-alkanes and primary alcohols by CYP153 enzymes from Mycobacterium marinum and Polaromonas sp. strain JS666," Org. Biomol. Chem. 9: 6727-6733 (2011).
Scheps et al., "Synthesis of [omega]-hydroxyl dodecanoic acid based on an engineered CYP153A fusion construct," Microbial Biotechnology, Aug. 1, 2013, 14 pages.
Schultz et al., "Expression and secretion in yeast of a 400-kDa envelope glycoprotein derived from Epstein-Barr virus," Gene 54: 113-123 (1987).
Smith et al., "Production of Human Beta Interferon in Insect Cells Infected with a Vaculovirus Expression Vector," Mol. Cell Biol. 3(12): 2156-2165 (1983).
Smith et al., "Single-step purification of polypeptides expressed in Escherichia coli as fusions with glutathione S-transferase," Gene 67: 31-40 (1988).

(56) References Cited

OTHER PUBLICATIONS

Soydan et al., "The Evaluation of the Role of Beta-Hydroxy Fatty Acids on Chronic Inflammation and Insulin Resistance," Mediators of Inflammation, 2006, vol. 2006, pp. 1-6.
Steen et al., "Microbial production of fatty-acid derived fuels and chemicals from plant biomass," Nature Letters, vol. 463, 2010, pp. 559-562.
Stemmer, "DNA shuffling by random fragmentation and reassembly: In vitro recombination for molecular evolution," Proc. Natl. Acad. Sci. USA. 91: 10747-10751 (1994).
Studier et al., "Use of T7 RNA Polymerase to Direct Expression of Cloned Genes," Methods in Enzymology, 185: 60-89 (1990).
Studier et al., Gene Expression Technology: Methods in Enzymology 185, Academic Press, San Diego, CA, pp. 60-89 (1990).
Stuiver et al. "Discussion: Reporting of 14C Data," Radiocarbon 19: 355-363 (1977).
U.S. Office Action on U.S. Appl. No. 14/897,285 dated Feb. 17, 2017.
Van Beilen, "Cytochrome P450 Alkane Hydroxylases of the CYP153 Family are Common in Alkane-Degrading Eubacteria Lacking Integral Membrane Alkane Hydroxylases," Appl. Environ. Microbiol. 72(1): 59-65 (2006).
Van Bogaert et al., "The Role of cytochrome P450 monoxygenases in microbial fatty acid metabolism," FEBS Journal, Jan. 2011, pp. 206-221.
Wacey et al., Disentangling the perturbational effects of amino acid substitutions in the DNA-binding domain of p53., Hum Genet, 1999, vol. 104, pp. 15-22.
Whitehouse et al., "P450BM3 (CYP102A1): connecting the dots," Chem. Soc. Rev. 41: 1218-1260 (2012).
Yang et al., "Efficient Method for the Synthesis of Chiral Pyrrolidine Derivatives via Ring-Closing Enyne Metathesis Reaction," Org. Letters, Feb. 6, 2007, vol. 9, pp. 769-771.
Bordeaux et al., "A Regioselective Biocatalyst for Alkane Activation under Mild Conditions," Angewandte Chemie International Edition, Feb. 25, 2011, vol. 50, pp. 2075-2079 (abstract—1 page only).
First Examination Report in AU Patent Application No. 2014277874 dated Nov. 19, 2019, 3 pages.
Foreign Action other than Search Report on BR 112016029235.9 dated Dec. 2, 2019, 6 pages with translation.
Office Action on BR 112015031233-0, dated Oct. 23, 2019, 7 pages with translation.
Sambrook et al., "Molecular Cloning: A Laboratory Manual," 2nd Ed., Cold Spring Harbor Laboratory Press, Dec. 1989, pp. 16.30-16.37.
Substantive Examination Adverse Report in MY Patent Application No. PI2015002915, dated Nov. 27, 2019, 5 pages with translation.
Notice of Reasons for Rejection in JP Patent Application No. 2016-573541 dated Apr. 20, 2020 (with English translation) (6 pages).
Partial Search Report in EP Patent Application No. 20160184.6 dated May 7, 2020, 14 pages.
Sumire Honda Malca, et al.,"11 Bacterial CYP153A monooxygenases for the synthesis of omega-hydroxylated fatty acids 11," Chemical Communications—Chemcom; [6015D], Royal Society of Chemistry, GB , Mar. 1, 2012, vol. 48, pp. 5115-5117.
Examination Report No. 1 in AU Patent Application No. 2015277261 dated Feb. 11, 2020 (3 pages).
Non-Final Office Action in U.S. Appl. No. 15/319,272 dated Feb. 25, 2020.
Notice of Allowance in U.S. Appl. No. 14/897,285 dated Mar. 2, 2020.
Notice of Reasons for Rejection in JP Patent Application No. 2016-573541 dated Apr. 16, 2020 (with English translation) (6 pages).
Preliminary Office Action in BR Patent Application No. 112018012193-2 dated Mar. 10, 2020 (with English translation) (6 pages).
Rejection Decision in CN Patent Application No. 201480033702.8 dated Apr. 2, 2020 (with English translation) (19 pages).
First Office Action in CA Patent Application No. 2915229, dated Jun. 8, 2020 (7 pages).
Second Substantive Examination Adverse Report on MY PI2015002915, dated May 29, 2020 (2 pages).

* cited by examiner

FIG. 3

MPTLPRTFDDIQSRLINATSRVVPMQRQIQGLKFLMSAKRKTFGPRRPMPEFVETPIPDVNTLALEDIDVSNPFLYRQGQWRA
YFKRLRDEAPVHYQKNSPFGPFWSVTRFEDILFVDKSHDLFSAEPQIILGDPPEGLSVEMFIAMDPPKHDVQRSSVQGVVAPK
NLKEMEGLIRSRTGDVLDSLPTDKPFNWVPAVSKELTGRMLATLLDFPYEERHKLVEWSDRMAGAASATGGEFADENAMF
DDAADMARSFSRLWRDKEARRAAGEEPGFDLISLLQSNKETKDLINRPMEFIGNLTLLIVAGNDTTRNSMSGGLVAMNEFPR
EFEKLKAKPELIPNMVSEIIRWQTPLAYMRRIAKQDVELGGQTIKKGDRVVMWYASGNRDERKFDNPDQFIIDRKDARNHM
SFGYGVHRCMGNRLAELQLRILWEEILKRFDNIEVVEEPERVQSNFVRGYSRLMVKLTPNSVLRHQPVTIGEPAARAVSRT
VTVERLDRIADDVLRLVLRDAGGKTLPTWTPGAHIDLDLGALSRQYSLCGAPDAPSYEIAVHLDPESRGGSRYTHEQLEVGSP
LRMRGPRNHFALDPGAEHYVFVAGGIGITPVLAMADHARARGWSYELHYCGRNRSGMAYLERVAGHGDRAALHVSEEGT
RIDLAALLAEPAPGVQIYACGPGRLLAGLEDASRNWPDGALHVEHFTSSLAALDPDVEHAFDLELRDSGLTVRVEPTQTVLD
ALRANNIDVPSDCEEGLCGSCEVAVLDGEVDHRDTVLTKAERAANRQMMTCCSRACGDRLALRL

FIG. 4

MPTLPRTFDDIQSRLJNATSRVVPMQRQIQGLKFLMSAKRKTFGPRRPMPEFVETPIPDVNTLALEDIDVSNPFLYRQGQWRA
YFKRLRDEAPVHYQKNSPFGPFWSVTRFEDILFVDKSHDLFSAEPQIILGDPPEGLSVEMFIAMDPPKHDVQRSSVQGVVAPK
NLKEMEGLJRSRTGDVLDSLPTDKPFNWVPAVSKELTGRMLATLLDFPYEERHKLVEWSDRMAGAASATGGEFADENAMF
DDAADMARSFSRLWRDKEARRAAGEEPGFDLISLLQSNKETKDLINRPMEFIGNLTLLIVAGNDTTRNSMSGGLVAMNEFPR
EFEKLKAKPELIPNMVSEIIRWQTPLAYMRRIAKQDVELGGQTIKKGDRVVMWYASGNRDERKFDNPDQFIIDRKDARNHM
SFGYGVHRCMGNRLAELQLRILWEEILKRFDNIEVVEEPERVQSNFVRGYSRLMVKLTPNSVLHRHQPVTIGEPAARAVSRT
VTVERLDRIADDVLRLVLRDAGGKTLPTWTPGAHIDLDLGALSRQYSLCGAPDAPSYEIAVHLDPESRGGSRYIHEQLEVGSP
LRMRGPRNHFALDPGAEHYVFVAGGIGTPVLAMADHARARGWSYELHYCGRNRSGMAYLERVAGHGDRAALHVSEEGT
RIDLAALLAEPAPGVQIYACGPGRLLAGLEDASRNWPDGALHVEHFTSSLAALDPDVEHAFDLELRDSGLTVRVEPTQTVLD
ALRANNIDVPSDCEEGLCGSCEVAVLDGEVDHRDTVLTKAERAANRQMMTCCSRACGDRLVLRL

OMEGA-HYDROXYLASE-RELATED FUSION POLYPEPTIDE VARIANTS WITH IMPROVED PROPERTIES

CROSS-REFERENCE TO RELATED APPLICATIONS

This application is a continuation-in-part of International Application No. PCT/EP2015/079832, filed Dec. 15, 2015, the entire disclosure of which is hereby incorporated by reference.

SEQUENCE LISTING

The instant application contains a Sequence Listing which has been submitted electronically in ASCII format and is hereby incorporated by reference in its entirety. Said ASCII copy, created on Dec. 12, 2016, is named LS00054-PCT3_SL.txt and is 936,451 bytes in size.

FIELD

The disclosure relates to omega-hydroxylase-related fusion polypeptides and variants thereof that result in improved omega-hydroxylated fatty acid derivative production when expressed in recombinant host cells. The disclosure further relates to microorganisms for expressing the omega-hydroxylase-related fusion polypeptides and variants thereof for the production of omega-hydroxylated fatty acid derivatives.

BACKGROUND

Cytochrome P450 monooxygenases (P450s) are a diverse group of enzymes. They are categorized into families and subfamilies. When they share a greater or equal than forty percent amino acid identity they belong to the same family. When they share a greater or equal than fifty five percent amino acid identity they belong to the same subfamily. P450s use fatty acids as substrates and catalyze hydroxylation reactions. Bacteria have several P450 systems involved in alkane degradation and fatty acid modification and more than 1000 microbial P450s are known to date. One particular P450 subfamily is known as cyp153A, wherein the first was cloned from *Acinetobacter calcoaceticus* in 2001. Since then, similar enzymes have been identified in other alkane-utilizing species such as *Sphingomonas* sp. HXN200, *Mycobacterium* sp. HXN1500, and *Alcanivorax borkumensis* (Van Bogaert et al. (2011) *FEBS Journal* 278:206-221). Several P450s from the bacterial CYP153A subfamily are alkane omega-hydroxylases (ω-hydroxylases, also referred to as ω-oxygenases) with high terminal regioselectivity. CYP153As have also been associated with the synthesis of industrially relevant omega-hydroxylated (ω-hydroxylated) aliphatic compounds, such as primary alcohols, ω-hydroxylated fatty acids and bi-functional fatty acid derivatives such as α,ω-dicarboxylic acids and α,ω-diols (Honda Malca et al. (2012) *Chem. Commun.* 48:5115-5117).

SUMMARY

The present disclosure provides omega-hydroxylase-related fusion polypeptides and variants thereof that can produce omega-hydroxylated- and bi-functional fatty acid derivatives in host cells. More specifically, the present disclosure provides CYP153A-reductase hybrid fusion polypeptide variants that produce omega-hydroxylated- (ω-hydroxylated) and bi-functional fatty acid derivatives and compositions thereof including ω-hydroxylated fatty acids, ω-hydroxylated fatty esters, α,ω-diacids, α,ω-diesters, α,ω-diols and chemicals derived therefrom such as macrolactones. Also provided are specific CYP153A-reductase hybrid fusion nucleic acid and protein sequences as well as recombinant host cells and cell cultures that encompass such engineered CYP153A-reductase hybrid fusion polypeptide variants. The disclosure also provides methods of using the recombinant CYP153A-reductase hybrid fusion polypeptide variant-expressing host cells in order to make ω-hydroxylated and/or bi-functional fatty acid derivatives or compositions thereof.

One aspect of the disclosure provides a CYP153A-reductase hybrid fusion polypeptide variant that catalyzes the conversion of a fatty acid to an ω-hydroxylated (ω-OH) fatty acid or fatty acid derivative, wherein the CYP153A-reductase hybrid fusion polypeptide variant has at least about 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the CYP153A-reductase hybrid fusion polypeptide sequence of SEQ ID NO: 38. Further included are methods for expressing the CYP153A-reductase hybrid fusion polypeptide and variants thereof. In one aspect, the CYP153A-reductase hybrid fusion polypeptide variant has at least 80%, 81%, 82%, 83%, 84%, 85%, 86%, 87%, 88%, 89%, 90%, 91%, 92%, 93%, 94%, 95%, 96%, 97%, 98%, 99% or 100% sequence identity to SEQ ID NO: 38 and expression of the CYP153A-reductase hybrid fusion polypeptide variant in a recombinant host cell results in a higher titer of ω-OH fatty acids or fatty acid derivatives or compositions thereof as compared to the titer produced by expression of a wild type CYP153A or expression of the CYP153A-reductase hybrid fusion polypeptide of SEQ ID NO: 6 or SEQ ID NO: 38. In one aspect, the recombinant host cell produces an ω-OH fatty acid or ω-OH fatty acid derivative or composition thereof with a titer that is at least about 1%, 2%, 3%, 4%, 5%, 6%, 7%, 8%, 9%, 10%, 11%, 12%, 13%, 14%, 15%, 16%, 17%, 18%, 19% or 20% greater than the titer of an ω-OH fatty acid or ω-OH fatty acid derivative or composition thereof produced by a host cell expressing a corresponding wild type CYP153A or expressing the CYP153A-reductase hybrid fusion polypeptide of SEQ ID NO: 6 or SEQ ID NO: 38, when cultured in medium containing a carbon source under conditions effective to express the CYP153A-reductase hybrid fusion polypeptide variant. In another aspect, the ω-OH fatty acid or ω-OH fatty acid derivative or composition thereof is produced extracellularly.

In one aspect, the present disclosure provides a CYP153A-reductase hybrid fusion polypeptide variant comprising at least 80% or at least 90% sequence identity to the amino acid sequence of SEQ ID NO: 38, wherein the CYP153A-reductase hybrid fusion polypeptide variant comprises a mutation at amino acid position 12 and a mutation at each of amino acid positions: (a) 27, 119, 140, 157, 159, 233, and 244 of SEQ ID NO: 38; (b) 28, 61, 119, 231, 309, 413, and 480 of SEQ ID NO: 38; (c) 119, 231, and 480 of SEQ ID NO: 38; (d) 28, 77, 119, 141, 231 and 407 of SEQ ID NO: 38; (e) 28, 61, 141, 231, and 407 of SEQ ID NO: 38; (f) 28, 119, 231, and 244 of SEQ ID NO: 38; (g) 28, 407, and 480 of SEQ ID NO: 38; (h) 141, 231, 413, and 481 of SEQ ID NO: 38; (i) 28, 111, 231, and 407 of SEQ ID NO: 38; (j) 28, 61, 140, and 149 of SEQ ID NO: 38; (k) 28, 77, 119, 159, 231, 254, 407, and 480 of SEQ ID NO: 38; (l) 28, 254, 309, 407, and 451 of SEQ ID NO: 38; (m) 28, 254, 309, 407, and 480 of SEQ ID NO: 38; or (n) 28, 309, 407, 451, and 480 of SEQ ID NO: 38; wherein the CYP153A-reductase hybrid fusion polypeptide variant catalyzes the conversion of a fatty acid to an omega-hydroxylated fatty acid. In various embodiments, the said mutations under (a) at amino acid positions 12, 27, 119, 140, 157, 159, 233, and 244 of SEQ ID NO: 38 are amino acid substitutions. In various embodiments, the said mutations under (b) at amino acid positions 12, 28, 61, 119, 231, 309, 413, and 480 of SEQ ID NO: 38 are amino acid substitutions. In various embodiments, the said mutations under (c) at amino acid positions 12, 119, 231, and 480 of SEQ ID NO: 38 are amino acid substitutions. In various embodiments, the said mutations under (d) at amino acid positions 12, 28, 77, 119; 141, 231 and 407 of SEQ ID NO: 38 are amino acid substitutions. In various embodiments, the said mutations under (e) at amino acid positions 12, 28, 61, 141, 231, and 407 of SEQ ID NO: 38 are amino acid substitutions. In various embodiments, the said mutations under (f) at amino acid positions 12, 28, 119, 231, and 244 of SEQ ID NO: 38 are amino acid substitutions. In various embodiments, the said mutations under (g) at amino acid positions 12, 28, 407, and 480 of SEQ ID NO: 38 are amino acid substitutions. In various embodiments, the said mutations under (h) at amino acid positions 12, 141, 231, 413, and 481 of SEQ ID NO: 38 are amino acid substitutions. In various embodiments, the said mutations under (i) at amino acid positions 12, 28, 111, 231, and 407 of SEQ ID NO: 38 are amino acid substitutions. In various embodiments, the said mutations under (j) at amino acid positions 12, 28, 61, 140, and 149 of SEQ ID NO: 38 are amino acid substitutions. In various embodiments, the said mutations under (k) at amino acid positions 12, 28, 77, 119, 159, 231, 254, 407, and 480 are amino acid substitutions. In various embodiments, the said mutations under (l) at amino acid positions 12, 28, 254, 309, 407, and 451 of SEQ ID NO: 38 are amino acid substitutions. In various embodiments, the said mutations under (m) at amino acid positions 12, 28, 254, 309, 407, and 480 of SEQ ID NO: 38 are amino acid substitutions. In various embodiments, the said mutations under (n) at amino acid positions 12, 28, 309, 407, 451, and 480 of SEQ ID NO: 38 are amino acid substitutions. In one embodiment, the said mutations under (a) at amino acid positions 12, 27, 119, 140, 157, 159, 233, and 244 of SEQ ID NO: 38 are Q12W, R27L, K119R, S140N, S157R, V159M, S233L, and A244R, respectively. In one embodiment, the said mutations under (b) at amino acid positions 12, 28, 61, 119, 231, 309, 413, and 480 of SEQ ID NO: 38 are Q12R, Q28M, N61L, K119R, A231V, N309S, Y413R, and I480G, respectively. In one embodiment, the said mutations under (c) at amino acid positions 12, 119, 231, and 480 of SEQ ID NO: 38 are Q12R, K119R, A231V, and I480G, respectively. In one embodiment, the said mutations under (d) at amino acid positions 12, 28, 77, 119; 141, 231 and 407 of SEQ ID NO: 38 are Q12T, Q28M, R77Q, K119R, V141T, A231W and N407G, respectively. In one embodiment, the said mutations under (e) at amino acid positions 12, 28, 61, 141, 231, and 407 of SEQ ID NO: 38 are Q12R, Q28M, N61L, V141T, A231Y, and N407G, respectively. In one embodiment, the said mutations under (f) at amino acid positions 12, 28, 119, 231, and 244 of SEQ ID NO: 38 are Q12W, Q28M, K119R, A231Y, and A244R, respectively. In one embodiment, the said mutations under (g) at amino acid positions 12, 28, 407, and 480 of SEQ ID NO: 38 are Q12W, Q28T, N407G, and I480G, respectively. In one embodiment, the said mutations under (h) at amino acid positions 12, 141, 231, 413, and 481 of SEQ ID NO: 38 are Q12R, V141T, A231Y, Y413R, and G481I, respectively. In one embodiment, the said mutations under (i) at amino acid positions 12, 28, 111, 231, and 407 of SEQ ID NO: 38 are Q12T, Q28M, F111A, A231V, and N407G, respectively. In one embodiment, the said mutations under (j) at amino acid positions 12, 28, 61, 140, and 149 of SEQ ID NO: 38 are Q12T, Q28M, N61L, S140N, and P149R, respectively. In one embodiment, the said mutations under (k) at amino acid positions 12, 28, 77, 119, 159, 231, 254, 407, and 480 are Q12W, Q28T, R77Q, K119R, V159M, A231Y, R254G, N407G, and I480G, respectively. In one embodiment, the said mutations under (l) at amino acid positions 12, 28, 254, 309, 407, and 451 of SEQ ID NO: 38 are Q12W, Q28T, R254G, N309S, N407G, and V451M, respectively. In one embodiment, the said mutations under (m) at amino acid positions 12, 28, 254, 309, 407, and 480 of SEQ ID NO: 38 are Q12W, Q28T, R254G, N309S, N407G, and I480G, respectively. In one embodiment, the said mutations under (n) at amino acid positions 12, 28, 309, 407, 451, and 480 of SEQ ID NO: 38 are Q12W, Q28T, N309S, N407G, V451M, and I480G, respectively. In one preferred embodiment, the CYP153A-reductase hybrid fusion polypeptide variant of the above (a) further comprises a mutation at each of amino acid positions 141, 231 and 407 of SEQ ID NO: 38, or at each of amino acid positions 231, 407, 451, 757, 770 and 784 of SEQ ID NO: 38, or at each of amino acid positions 231, 407, 591, 643, 757 and 784 of SEQ ID NO: 38. In various embodiments, the said further mutations at each of amino acid positions 141, 231 and 407 of SEQ ID NO: 38 are amino acid substitutions. Also, in various embodiments the said further mutations at each of amino acid positions 231, 407, 451, 757, 770 and 784 of SEQ ID NO: 38 are amino acid substitutions. Also, in various embodiments the said further mutations at each of amino acid positions 231, 407, 591, 643, 757 and 784 of SEQ ID NO: 38 are amino acid substitutions. Preferably, the said further mutations at each of amino acid positions 141, 231 and 407 of SEQ ID NO: 38 are V141T, A231Y and N407G, respectively. Also, preferably the said mutations at each of amino acid positions 231, 407, 451, 757, 770 and 784 of SEQ ID NO: 38 are A231Y, N407G, V451M, E757A, T770G and M784I, respectively. Also, preferably the said mutations at each of amino acid positions 231, 407, 591, 643, 757 and 784 of SEQ ID NO: 38 are A231Y, N407G, E591Q, R643H, E757A and M784I, respectively. More preferably, the CYP153A-reductase hybrid fusion polypeptide variant of the present disclosure comprises the amino acid sequence of SEQ ID NO: 146, SEQ ID NO: 150, or SEQ ID NO: 160. In other embodiments of the present disclosure the CYP153A-reductase hybrid fusion polypeptide variant comprises the amino acid sequence of any one of SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, and SEQ ID NO: 124.

In another aspect, the present disclosure provides a CYP153A-reductase hybrid fusion polypeptide variant comprising at least 80% or at least 90% sequence identity to the amino acid sequence of SEQ ID NO: 38, wherein the CYP153A-reductase hybrid fusion polypeptide variant comprises a mutation in the RhF domain (or RhF reductase domain, or Red450RhF domain, or Red450RhF reductase domain, or P450RhF domain, or P450RhF reductase domain) at each of amino acid positions (a) 527, 544, 719, 757, 771, and 784 of SEQ ID NO: 38; (b) 527, 544, and 557 of SEQ ID NO: 38; (c) 770 and 784 of SEQ ID NO: 38; (d) 527, 591, 648, 719, 757, 771, and 784 of SEQ ID NO: 38; (e) 527, 591, 648, 757, and 771 of SEQ ID NO: 38; (f) 527, 544, 770, and 784 of SEQ ID NO: 38; (g) 527, 557, 770, and 784 of SEQ ID NO: 38; (h) 557, 757, and 770 of SEQ ID NO: 38; (i) 557, 757, and 771 of SEQ ID NO: 38; or (j) 757 and 770 of SEQ ID NO: 38; wherein the CYP153A-reductase hybrid fusion polypeptide variant catalyzes the conversion of a fatty acid to an omega-hydroxylated fatty acid. In various embodiments, the said mutations under under (a) at amino acid positions 527, 544, 719, 757, 771, and 784 of SEQ ID NO: 38 are amino acid substitutions. In various embodiments, the said mutations under (b) at amino acid positions 527, 544, and 557 of SEQ ID NO: 38 are amino acid substitutions. In various embodiments, the said mutations under (c) at amino acid positions 770 and 784 of SEQ ID NO: 38 are amino acid substitutions. In various embodiments, the said mutations under (d) at amino acid positions 527, 591, 648, 719, 757, 771, and 784 of SEQ ID NO: 38 are amino acid substitutions. In various embodiments, the said mutations under (e) at amino acid positions 527, 591, 648, 757, and 771 of SEQ ID NO: 38 are amino acid substitutions. In various embodiments, the said mutations under (f) at amino acid positions 527, 544, 770, and 784 of SEQ ID NO: 38 are amino acid substitutions. In various embodiments, the said mutations under (g) at amino acid positions 527, 557, 770, and 784 of SEQ ID NO: 38 are amino acid substitutions. In various embodiments, the said mutations under (h) at amino acid positions 557, 757, and 770 of SEQ ID NO: 38 are amino acid substitutions. In various embodiments, the said mutations under (i) at amino acid positions 557, 757, and 771 of SEQ ID NO: 38 are amino acid substitutions. In various embodiments, the said mutations under (j) at amino acid positions 757 and 770 of SEQ ID NO: 38 are amino acid substitutions. In one embodiment, the said mutations under under (a) at amino acid positions 527, 544, 719, 757, 771, and 784 of SEQ ID NO: 38 are D527E, D544N, R719W, E757A, V771F, and M784I, respectively. In one embodiment, the said mutations under (b) at amino acid positions 527, 544, and 557 of SEQ ID NO: 38 are D527E, D544N, and E557R, respectively. In one embodiment, the said mutations under (c) at amino acid positions 770 and 784 of SEQ ID NO: 38 are T770G and M784I, respectively. In one embodiment, the said mutations under (d) at amino acid positions 527, 591, 648, 719, 757, 771, and 784 of SEQ ID NO: 38 are D527E, E591Q, V648L, R719W, E757A, V771F, and M784I, respectively. In one embodiment, the said mutations under (e) at amino acid positions 527, 591, 648, 757, and 771 of SEQ ID NO: 38 are D527E, E591Q, V648L, E757A, and V771F, respectively. In one embodiment, the said mutations under (f) at amino acid positions 527, 544, 770, and 784 of SEQ ID NO: 38 are D527E, D544N, T770G, and M784I, respectively. In one embodiment, the said mutations under (g) at amino acid positions 527, 557, 770, and 784 of SEQ ID NO: 38 are D527E, E557R, T770G, and M784I, respectively. In one embodiment, the said mutations under (h) at amino acid positions 557, 757, and 770 of SEQ ID NO: 38 are E557W, E757A, and T770G, respectively. In one embodiment, the said mutations under (i) at amino acid positions 557, 757, and 771 of SEQ ID NO: 38 are E557R, E757A, and V771F, respectively. In one embodiment, the said mutations under (j) at amino acid positions 757 and 770 of SEQ ID NO: 38 are E757A and T770G, respectively. In some preferred embodiments of the present disclosure, the CYP153A-reductase hybrid fusion polypeptide variant comprises the amino acid sequence of any one of SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, and SEQ ID NO: 144.

In still another aspect, the present disclosure provides a CYP153A-reductase hybrid fusion polypeptide variant comprising at least 80% or at least 90% sequence identity to the amino acid sequence of SEQ ID NO: 38, wherein the CYP153A-reductase hybrid fusion polypeptide variant comprises a mutation at each of positions (a) 141, 231, 233, and 254 of SEQ ID NO: 38; (b) 141, 231, 233, and 244 of SEQ ID NO: 38; (c) 141, 231, 244, 451, 557, 749, and 770 of SEQ ID NO: 38; (d) 27, 28, 61, 141, 149, and 231 of SEQ ID NO: 38; (e) 141, 157, 231, 233, 244, 757, and 784 of SEQ ID NO: 38; (f) 28, 61, 140, 141, 231, 233, and 271 of SEQ ID NO: 38; or (g) 231, 233, 254, and 557 of SEQ ID NO: 38; wherein the CYP153A-reductase hybrid fusion polypeptide variant catalyzes the conversion of a fatty acid to an omega-hydroxylated fatty acid. In various embodiments, the said mutations under (a) at amino acid positions 141, 231, 233, and 254 of SEQ ID NO: 38 are amino acid substitutions. In various embodiments, the said mutations under (b) at amino acid positions 141, 231, 233, and 244 of SEQ ID NO: 38 are amino acid substitutions. In various embodiments, the said mutations under (c) at amino acid positions 141, 231, 244, 451, 557, 749, and 770 of SEQ ID NO: 38 are amino acid substitutions. In various embodiments, the said mutations under (d) at amino acid positions 27, 28, 61, 141, 149, and 231 of SEQ ID NO: 38 are amino acid substitutions. In various embodiments, the said mutations under (e) at amino acid positions 141, 157, 231, 233, 244, 757, and 784 of SEQ ID NO: 38 are amino acid substitutions. In various embodiments, the said mutations under (f) at amino acid positions 28, 61, 140, 141, 231, 233, and 271 of SEQ ID NO: 38 are amino acid substitutions. In various embodiments, the said mutations under (g) at amino acid positions 231, 233, 254, and 557 of SEQ ID NO: 38 are amino acid substitutions. In one embodiment, the said mutations under (a) at amino acid positions 141, 231, 233, and 254 of SEQ ID NO: 38 are V141T, A231Y, L233S, and R254G, respectively. In one embodiment, the said mutations under (b) at amino acid positions 141, 231, 233, and 244 of SEQ ID NO: 38 are V141T, A231Y, L233S, and R244A, respectively. In one embodiment, the said mutations under (c) at amino acid positions 141, 231, 244, 451, 557, 749, and 770 of SEQ ID NO: 38 are V141T, A231Y, R244A, V451M, E557W, E749L, and T770G, respectively. In one embodiment, the said mutations under (d) at amino acid positions 27, 28, 61, 141, 149, and 231 of SEQ ID NO: 38 are L27R, Q28M, N61L, V141T, P149G, and A231Y, respectively. In one embodiment, the said mutations under (e) at amino acid positions 141, 157, 231, 233, 244, 757, and 784 of SEQ ID NO: 38 are V141T, R157S, A231Y, L233S, R244A, E757A, and M784I, respectively. In one embodiment, the said mutations under (f) at amino acid positions 28, 61, 140, 141, 231, 233, and 271 of SEQ ID NO: 38 are Q28M, N61L, N140S, V141T, A231Y, L233S, and E271D, respectively. In one embodiment, the said mutations under (g) at amino acid positions 231, 233, 254, and 557 of SEQ ID NO: 38 are A231Y, L233S, R254G, and E557W, respectively. In some preferred embodiments of the present disclosure, the CYP153A-reductase hybrid fusion polypeptide variant of the present disclosure comprises the amino acid sequence of any one of SEQ ID NO: 148, SEQ ID NO: 152, SEQ ID NO: 154, SEQ ID NO: 156, SEQ ID NO: 158, SEQ ID NO: 162, and SEQ ID NO: 164.

In still another aspect, the present disclosure provides a CYP153A-reductase hybrid fusion polypeptide variant comprising at least 80% or at least 90% sequence identity to the amino acid sequence of SEQ ID NO: 98, wherein the CYP153A-reductase hybrid fusion polypeptide variant comprises a mutation at each of positions (a) 141, 231, and 407 of SEQ ID NO: 98; (b) 141, 231, 233, and 254 of SEQ ID NO: 98; (c) 231, 407, 451, 757, 770, and 784 of SEQ ID NO: 98; (d) 141, 231, 233, and 244 of SEQ ID NO: 98; (e) 141, 231, 244, 451, 557, 749, and 770 of SEQ ID NO: 98; (f) 27, 28, 61, 141, 149, and 231 of SEQ ID NO: 98; (g) 27, 119, 140, 141, 159, 231, 757, and 784 of SEQ ID NO: 98; (h) 231, 407, 591, 643, 757, and 784 of SEQ ID NO: 98; (i) 28, 61, 140, 141, 231, 233, and 271 of SEQ ID NO: 98; or (j) 231, 233, and 254 of SEQ ID NO: 98; wherein the CYP153A-reductase hybrid fusion polypeptide variant catalyzes the conversion of a fatty acid to an omega-hydroxylated fatty acid. In various embodiments, the said mutations under (a) at amino acid positions 141, 231, and 407 of SEQ ID NO: 98 are amino acid substitutions. In various embodiments, the said mutations under (b) at amino acid positions 141, 231, 233, and 254 of SEQ ID NO: 98 are amino acid substitutions. In various embodiments, the said mutations under (c) at amino acid positions 231, 407, 451, 757, 770, and 784 of SEQ ID NO: 98 are amino acid substitutions. In various embodiments, the said mutations under (d) at amino acid positions 141, 231, 233, and 244 of SEQ ID NO: 98 are amino acid substitutions. In various embodiments, the said mutations under (e) at amino acid positions 141, 231, 244, 451, 557, 749, and 770 of SEQ ID NO: 98 are amino acid substitutions. In various embodiments, the said mutations under (f) at amino acid positions 27, 28, 61, 141, 149, and 231 of SEQ ID NO: 98 are amino acid substitutions. In various embodiments, the said mutations under (g) at amino acid positions 27, 119, 140, 141, 159, 231, 757, and 784 of SEQ ID NO: 98 are amino acid substitutions. In various embodiments, the said mutations under (h) at amino acid positions 231, 407, 591, 643, 757, and 784 of SEQ ID NO: 98 are amino acid substitutions. In various embodiments, the said mutations under (i) at amino acid positions 28, 61, 140, 141, 231, 233, and 271 of SEQ ID NO: 98 are amino acid substitutions. In various embodiments, the said mutations under (j) at amino acid positions 231, 233, and 254 of SEQ ID NO: 38 are amino acid substitutions. In one embodiment, the said mutations under (a) at amino acid positions 141, 231, and 407 of SEQ ID NO: 98 are V141T, A231Y and N407G, respectively. In one embodiment, the said mutations under (b) at amino acid positions 141, 231, 233, and 254 of SEQ ID NO: 98 are V141T, A231Y, L233S, and R254G, respectively. In one embodiment, the said mutations under (c) at amino acid positions 231, 407, 451, 757, 770, and 784 of SEQ ID NO: 98 are A231Y, N407G, V451M, E757A, T770G and M784I, respectively. In one embodiment, the said mutations under (d) at amino acid positions 141, 231, 233, and 244 of SEQ ID NO: 98 are V141T, A231Y, L233S, and R244A, respectively. In one embodiment, the said mutations under (e) at amino acid positions 141, 231, 244, 451, 557, 749, and 770 of SEQ ID NO: 98 are V141T, A231Y, R244A, V451M, E557W, E749L, and T770G, respectively. In one embodiment, the said mutations under (f) at amino acid positions 27, 28, 61, 141, 149, and 231 of SEQ ID NO: 98 are L27R, Q28M, N61L, V141T, P149G, and A231Y, respectively. In one embodiment, the said mutations under (g) at amino acid positions 141, 157, 231, 233, 244, 757, and 784 of SEQ ID NO: 98 are V141T, R157S, A231Y, L233S, R244A, E757A, and M784I, respectively. In one embodiment, said mutations under (h) at amino acid positions 231, 407, 591, 643, 757, and 784 of SEQ ID NO: 98 are A231Y, N407G, E591Q, R643H, E757A and M784I, respectively. In one embodiment, the said mutations under (i) at amino acid positions 28, 61, 140, 141, 231, 233, and 271 of SEQ ID NO: 98 are Q28M, N61L, N140S, V141T, A231Y, L233S, and E271D, respectively. In one embodiment, the said mutations under (j) at amino acid positions 231, 233, 254, and 557 of SEQ ID NO: 98 are A231Y, L233S, R254G, and E557W, respectively. In some preferred embodiments of the present disclosure, the CYP153A-reductase hybrid fusion polypeptide variant of the present disclosure comprises the amino acid sequence of any one of SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160; SEQ ID NO: 162, and SEQ ID NO: 164.

In various embodiments of the present disclosure, expression of a CYP153A-reductase hybrid fusion polypeptide variant provided by the present disclosure in a recombinant host cell results in a higher titer of an omega-hydroxylated fatty acid as compared to the titer of an omega-hydroxylated fatty acid produced by expression of, e.g., the CYP153A-reductase hybrid fusion polypeptide of SEQ ID NO: 6 or SEQ ID NO: 38 in a corresponding host cell. Further, in various embodiments of the present disclosure, a CYP153A-reductase hybrid fusion polypeptide variant provided by the present disclosure is a hybrid CYP153A-RedRhF fusion protein variant.

In one aspect, the present disclosure provides a recombinant host cell expressing a CYP153A-reductase hybrid fusion polypeptide variant provided by the present disclosure. In various embodiments, the recombinant host cell is further expressing a thioesterase polypeptide of EC 3.1.2.-, EC 3.1.1.5 or EC 3.1.2.14. Also, in various embodiments the recombinant host cell produces an omega-hydroxylated fatty acid composition with a titer that is at least 10% greater, at least 15% greater, at least 20% greater, at least 25% greater, or at least 30% greater than the titer of an omega-hydroxylated fatty acid composition produced by a host cell expressing a corresponding CYP153A-reductase hybrid fusion polypeptide comprising SEQ ID NO: 38 or SEQ ID NO: 6, when cultured in medium containing a carbon source.

In another aspect, the present disclosure provides a cell culture comprising a recombinant host cell of the present disclosure.

In another aspect, the present disclosure provides a method of producing an omega-hydroxylated fatty acid, comprising: (i) culturing a recombinant host cell of the present disclosure, or a cell culture of the present disclosure, in the presence of a carbon source; and (ii) harvesting an omega-hydroxylated fatty acid.

In another aspect, the present disclosure provides a recombinant microorganism comprising a pathway engineered to express at least two nucleic acid sequences encoding a polypeptide comprising: (i) a thioesterase of EC 3.1.2.-, EC 3.1.1.5, or EC 3.1.2.14; and (ii) a CYP153A-reductase hybrid fusion polypeptide variant of the present disclosure.

In various embodiments of the resent disclosure, the CYP153A-reductase hybrid fusion polypeptide variant is a self-sufficient CYP153A-RedRhF hybrid fusion protein variant.

Another aspect of the present disclosure provides a CYP153A-reductase hybrid fusion polypeptide variant having at least about 90%, 91%, 93%, 94%, 95%, 96%, 97%, 98%, or 99% sequence identity to SEQ ID NO: 6 and having at least one mutation at an amino acid position including position 796, 141, 231, 27, 82, 178, 309, 407, 415, 516 and/or 666, wherein the CYP153A-reductase hybrid fusion polypeptide variant catalyzes the conversion of a fatty acid to an ω-OH fatty acid. The CYP153A-reductase hybrid fusion polypeptide variant has a mutation at any one or more of the following positions, including position A796V where alanine (A) is substituted with (i.e., replaced with) valine (V); position V141I where valine is substituted with isoleucine (I); position V141Q where valine (V) is substituted with glutamine (Q); position V141G where valine (V) is substituted with glycine (G); position V141M where valine (V) is substituted with methionine (M); position V141L where valine (V) is substituted with leucine (L); position V141T where valine (V) substituted with threonine (T); position A231T where alanine (A) is substituted with threonine (T); position R27L where arginine (R) is substituted with lysine (L); position R82D where arginine (R) is substituted with aspartic acid (D); position R178N where arginine (R) is substituted with asparagine (N); position N309R where asparagine (N) is substituted with arginine (R); position N407A where asparagine (N) is substituted with alanine (A); position V415R where valine (V) is substituted with arginine (R); position T516V where threonine (T) is substituted with valine (V); position P666A where proline (P) is substituted with alanine (A); and position P666D where proline (P) is substituted with aspartic acid (D). Examples of CYP153A-reductase hybrid fusion polypeptide variants include SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28 or SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44 and SEQ ID NO: 46 as shown in Sequence Table A. In one embodiment, the CYP153A-reductase hybrid fusion polypeptide variant is a hybrid CYP153A-RedRhF-type fusion protein variant. In another embodiment, the CYP153A-reductase hybrid fusion polypeptide variant in a recombinant host cell results in a higher titer of an the ω-OH fatty acid or ω-OH fatty acid derivative or composition thereof as compared to the titer of an the ω-OH fatty acid or ω-OH fatty acid derivative or composition thereof produced by expression of a CYP153A-reductase hybrid fusion polypeptide (template; e.g., SEQ ID NO: 6, SEQ ID NO: 38, SEQ ID NO: 98) in a corresponding host cell. In another embodiment, the CYP153A-reductase hybrid fusion polypeptide variant has a mutation at amino acid position 796, including A796V. In another embodiment, the CYP153A-reductase hybrid fusion polypeptide variant has a mutation at amino acid position 231, including A231T. In another embodiment, the CYP153A-reductase hybrid fusion polypeptide variant has a mutation at amino acid position 141, including V141I or V141T. Herein, the expression of the CYP153A-reductase hybrid fusion polypeptide variant with mutations A796V, V141I or V141T, and/or A231T in a recombinant host cell result in a higher titer of an ω-OH $C_{12}$ or $C_{16}$ fatty acid, respectively, as compared to a titer of an ω-OH $C_{12}$ or $C_{16}$ fatty acid produced by expression of a CYP153A-reductase hybrid fusion polypeptide (template; e.g., SEQ ID NO: 6, SEQ ID NO: 38, SEQ ID NO: 98).

The disclosure further contemplates a cell culture with a recombinant host cell expressing a CYP153A-reductase hybrid fusion polypeptide variant as provided by the present disclosure. The ω-OH fatty acid or fatty acid derivative or composition thereof may include one or more of a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$ and a $C_{20}$ ω-OH fatty acid or fatty acid derivative. The ω-OH fatty acid or fatty acid derivative or composition thereof may include a saturated or unsaturated ω-OH fatty acid or fatty acid derivative. In another embodiment, the ω-OH fatty acid or fatty acid derivative or composition thereof may include one or more of a $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{15:1}$, $C_{19:1}$ and a $C_{20:1}$ unsaturated ω-OH fatty acid or fatty acid derivative. In another embodiment, the ω-OH fatty acid or fatty acid derivative or composition thereof may include an ω-OH $C_{12}$ and/or $C_{16}$ and/or $C_{16:1}$ fatty acid or fatty acid derivative.

Another aspect of the disclosure provides a method of producing an ω-OH fatty acid or fatty acid derivative or composition thereof, comprising culturing the host cell expressing a CYP153A-reductase hybrid fusion polypeptide variant of the present disclosure with a carbon source; and harvesting an ω-OH fatty acid or an ω-OH fatty acid derivative. The method provides for an increase/improvement in titer of the ω-OH fatty acid or ω-OH fatty acid derivative or composition thereof. In one aspect, the ω-OH fatty acid or fatty acid derivative is at least about 20% to 30% greater than the titer of an ω-OH fatty acid or fatty acid derivative produced by a CYP153A-reductase hybrid fusion polypeptide-expressing host cell, in particular by a host cell expressing the CYP153A-reductase hybrid fusion polypeptide of, e.g., SEQ ID NO: 6, SEQ ID NO: 38, or SEQ ID NO: 98. In another aspect, the ω-OH fatty acid or fatty acid derivative or composition thereof is produced at a titer of about 15 g/L to about 25 g/L from a carbon source, in particular a carbon source from a renewable feedstock. In various embodiments, the carbon based renewable feedstock is selected from the group consisting of corn, sugar cane, sorghum, beet, switch grass, ensilage, straw, lumber, pulp, sewage, garbage, cellulosic urban waste, flu-gas, syn-gas, biomass hydrolysate, and carbon dioxide.

Another aspect of the disclosure provides a CYP153A-reductase hybrid fusion polypeptide variant with at least about 90%, 91%, 93%, 94%, 95%, 96%, 97%, 98%, 99% or 100% sequence identity to SEQ ID NO: 32 having a mutation at V141I and A231T, wherein the CYP153A-reductase hybrid fusion polypeptide variant catalyzes the conversion of a fatty acid to an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. Another aspect of the disclosure provides a CYP153A-reductase hybrid fusion polypeptide variant with at least about 90%, 91%, 93%, 94%, 95%, 96%, 97%, 98%, 99% or 100% sequence identity to SEQ ID NO: 34 having a mutation at R27L, R82D, V141M, R178N and N407A, wherein the CYP153A-reductase hybrid fusion polypeptide variant catalyzes the conversion of a fatty acid to an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. Another aspect of the disclosure provides a CYP153A-reductase hybrid fusion polypeptide variant with at least about 90%, 91%, 93%, 94%, 95%, 96%, 97%, 98%, 99% or 100% sequence identity to SEQ ID NO: 36 having a mutation at P666A, wherein the CYP153A-reductase hybrid fusion polypeptide variant catalyzes the conversion of a fatty acid to an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. Another aspect of the disclosure provides a CYP153A-reductase hybrid fusion polypeptide variant with at least about 90%, 91%, 93%, 94%, 95%, 96%, 97%, 98%, 99% or 100% sequence identity to SEQ ID NO: 38 having a mutation at A796V, wherein the CYP153A-reductase hybrid fusion polypeptide variant catalyzes the conversion of a fatty acid to an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. Another aspect of the disclosure provides a CYP153A-reductase hybrid fusion polypeptide variant with at least about 90%, 91%, 93%, 94%, 95%, 96%, 97%, 98%, 99% or 100% sequence identity to SEQ ID NO: 40 having a mutation at A796V, P666D and T516V, wherein the CYP153A-reductase hybrid fusion polypeptide variant catalyzes the conversion of a fatty acid to an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. Another aspect of the disclosure provides a CYP153A-reductase hybrid fusion polypeptide variant with at least about 90%, 91%, 93%, 94%, 95%, 96%, 97%, 98%, 99% or 100% sequence identity to SEQ ID NO: 42 having a mutation at V141I, A231T and A796V, wherein the CYP153A-reductase hybrid fusion polypeptide variant catalyzes the conversion of a fatty acid to an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. Another aspect of the disclosure provides a CYP153A-reductase hybrid fusion polypeptide variant with at least about 90%, 91%, 93%, 94%, 95%, 96%, 97%, 98%, 99% or 100% sequence identity to SEQ ID NO: 44 having a mutation at R27L, R82D, V141M, R178N, N407A and A796V, wherein the CYP153A-reductase hybrid fusion polypeptide variant catalyzes the conversion of a fatty acid to an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. Another aspect of the disclosure provides a CYP153A-reductase hybrid fusion polypeptide variant with at least about 90%, 91%, 93%, 94%, 95%, 96%, 97%, 98%, 99% or 100% sequence identity to SEQ ID NO: 46 having a mutation at V141T, A231T and A796V, wherein the CYP153A-reductase hybrid fusion polypeptide variant catalyzes the conversion of a fatty acid to an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof.

The disclosure further contemplates a recombinant host cell expressing a CYP153A-reductase hybrid fusion polypeptide variant provided by the present disclosure. In one embodiment, the recombinant host cell expresses a CYP153A-reductase hybrid fusion polypeptide variant of the present disclosure and a thioesterase polypeptide of EC 3.1.2.- or EC 3.1.1.5 or EC 3.1.2.14, wherein the recombinant host cell produces an ω-OH fatty acid or a composition thereof with a titer that is at least 10% greater, at least 15% greater, at least 20% greater, at least 25% greater, or at least 30% greater than the titer of an ω-OH fatty acid or composition thereof produced by a host cell expressing a corresponding CYP153A-reductase hybrid fusion polypeptide, e.g., expressing the CYP153A-reductase hybrid fusion polypeptide of SEQ ID NO: 6 or SEQ ID NO: 38, when cultured in medium containing a carbon source under conditions effective to express a CYP153A-reductase hybrid fusion polypeptide variant of the present disclosure. In one embodiment, the ω-OH fatty acid or composition thereof can be produced at a titer of about 15 g/L to about 25 g/L. In another embodiment, the ω-OH fatty acid or composition thereof is produced extracellularly.

In one aspect, the present disclosure provides a recombinant microorganism engineered to express a CYP153A-reductase hybrid fusion polypeptide variant of the present disclosure. In various embodiments, the recombinant microorganism produces or is capable of producing ω-hydroxy fatty acids or ω-OH fatty acid derivatives, specifically ω-hydroxy fatty acid methyl esters. In various embodiments, the recombinant microorganism is engineered to further express a nucleic acid sequence encoding a polypeptide comprising an alcohol dehydrogenase of EC 1.1.1.1/2 or an alcohol oxidase of EC 1.1.3.13 or EC 1.1.3.20, preferably wherein the recombinant microorganism produces ω-hydroxy fatty acid derivatives selected from the group consisting of ω-oxo fatty acids and ω-oxo fatty acid methyl esters. This recombinant microorganism may be engineered to further express a nucleic acid sequence encoding a polypeptide comprising an aldehyde dehydrogenase of EC 1.2.1.3/4/5 or an aldehyde oxidase of EC 1.2.3.1, wherein the recombinant microorganism produces ω-hydroxy fatty acid derivatives that are α,ω-diacids or ω-carboxy fatty acid methyl esters. This recombinant microorganism may be engineered to further express a nucleic acid sequence encoding a polypeptide comprising an acyl-CoA ligase of EC 6.2.1.3 or an acyl-CoA transferase of EC 2.8.3.6, wherein the recombinant microorganism produces ω-hydroxy fatty acid derivatives that are α,ω-diesters. In various embodiments, the above-mentioned recombinant microorganism, which is engineered to further express a nucleic acid sequence encoding a polypeptide comprising an alcohol dehydrogenase of EC 1.1.1.1/2 or an alcohol oxidase of EC 1.1.3.13 or EC 1.1.3.20, may be engineered to further express a nucleic acid sequence encoding a polypeptide comprising an amino transferase of EC 2.6.1 or an amine dehydrogenases of EC 1.4.9, EC 1.4.98 or EC 1.4.99 to produce ω-hydroxy fatty acid derivatives that are selected from the group consisting of ω-amino fatty acids and ω-amino fatty acid methyl esters. In various embodiments, the recombinant microorganism may be engineered to further express a nucleic acid sequence encoding a polypeptide comprising an alcohol dehydrogenase of EC 1.1.-.- and a carboxylic acid reductase of 1.2.99., wherein the ω-hydroxy fatty acid derivative produced is a α,ω-diol. In another aspect, the disclosure encompasses a recombinant microorganism having a pathway engineered to express at least two nucleic acid sequences encoding a polypeptide including a thioesterase of EC 3.1.2.- or EC 3.1.1.5 or 3.1.2.14; and a CYP153A-reductase hybrid fusion polypeptide variant of the present disclosure. The recombinant microorganism can be used for producing an ω-OH fatty acid or ω-OH fatty acid derivative in vivo when grown in a fermentation broth in the presence of a carbon source from a renewable feedstock. In one embodiment, the CYP153A-reductase hybrid fusion polypeptide variant is a self-sufficient CYP153A-RedRhF hybrid fusion protein variant.

In one aspect, the present disclosure provides a method of producing an ω-hydroxy fatty acid derivative comprising: (a) culturing a recombinant microorganism of the present disclosure in a culture medium comprising a renewable feedstock containing a carbon source, and (b) isolating a ω-hydroxy fatty acid derivative from the recombinant microorganism or from the culture medium. Preferably, the said renewable feedstock is carbon based, preferably wherein said carbon based renewable feedstock is selected from the group consisting of corn, sugar cane, sorghum, beet, switch grass, ensilage, straw, lumber, pulp, sewage, garbage, cellulosic urban waste, flu-gas, syn-gas, biomass hydrolysate, and carbon dioxide.

Another aspect of the present disclosure provides a cell culture including a recombinant host cell of the present disclosure. The cell culture of the present disclosure can produce an ω-OH fatty acid or composition thereof. In one embodiment, the cell culture produces an ω-OH fatty acid including one or more of a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. In one embodiment, the cell culture produces an unsaturated ω-OH $C_{16:1}$ fatty acid or composition thereof. In another embodiment, the cell culture produces a saturated ω-OH $C_{16}$ fatty acid or composition thereof. In one embodiment, the cell culture produces an unsaturated ω-OH $C_{12:1}$ fatty acid or composition thereof. In another embodiment, the cell culture produces a saturated ω-OH $C_{12}$ fatty acid or composition thereof. In one embodiment, the cell culture produces an unsaturated ω-OH $C_{14:1}$ fatty acid or composition thereof. In another embodiment, the cell culture produces a saturated ω-OH $C_{14}$ fatty acid or composition thereof. In one embodiment, the cell culture produces an unsaturated ω-OH $C_{18:1}$ fatty acid or composition thereof. In another embodiment, the cell culture produces a saturated ω-OH $C_{18}$ fatty acid or composition thereof. In one embodiment, the cell culture produces an unsaturated ω-OH $C_{10:1}$ fatty acid or composition thereof. In another embodiment, the cell culture produces a saturated ω-OH $C_{10}$ fatty acid or composition thereof. In one embodiment, the cell culture produces an unsaturated ω-OH $C_{8:1}$ fatty acid or composition thereof. In another embodiment, the cell culture produces a saturated ω-OH $C_8$ fatty acid or composition thereof. In one embodiment, the cell culture produces an unsaturated ω-OH $C_{20:1}$ fatty acid or composition thereof. In another embodiment, the cell culture produces a saturated ω-OH $C_{20}$ fatty acid or composition thereof. In yet another embodiment, additional saturated or unsaturated ω-OH fatty acids or compositions thereof are produced by the recombinant host cell.

Still another aspect of the present disclosure provides a method of producing an ω-OH fatty acid, comprising culturing a host cell of the present disclosure with a carbon source; and harvesting an ω-OH fatty acid or composition thereof. The method provides for an increase/improvement in titer of the ω-OH fatty acid produced. The method contemplates harvesting an ω-OH fatty acid that is a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. In one embodiment, the harvested ω-OH fatty acid is an unsaturated ω-OH $C_{16:1}$ fatty acid or composition thereof. In another embodiment, the harvested ω-OH fatty acid is a saturated ω-OH $C_{16}$ fatty acid or composition thereof. In one embodiment, the harvested ω-OH fatty acid is an unsaturated ω-OH $C_{12:1}$ fatty acid or composition thereof. In another embodiment, the harvested ω-OH fatty acid is a saturated ω-OH $C_{12}$ fatty acid or composition thereof. In one embodiment, the harvested ω-OH fatty acid is an unsaturated ω-OH $C_{14:1}$ fatty acid or composition thereof. In another embodiment, the harvested ω-OH fatty acid is a saturated ω-OH $C_{14}$ fatty acid or composition thereof. In one embodiment, the harvested ω-OH fatty acid is an unsaturated ω-OH $C_{18:1}$ fatty acid or composition thereof. In another embodiment, the harvested ω-OH fatty acid is saturated ω-OH $C_{18}$ fatty acid or composition thereof. In one embodiment, the harvested ω-OH fatty acid is an unsaturated ω-OH $C_{10:1}$ fatty acid or composition thereof. In another embodiment, the harvested ω-OH fatty acid is a saturated ω-OH $C_{10}$ fatty acid or composition thereof. In one embodiment, the harvested ω-OH fatty acid is an unsaturated ω-OH $C_{8:1}$ fatty acid or composition thereof. In another embodiment, the harvested ω-OH fatty acid is a saturated ω-OH $C_8$ fatty acid or composition thereof. In one embodiment, the harvested ω-OH fatty acid is an unsaturated ω-OH $C_{20:1}$ fatty acid or composition thereof. In another embodiment, the harvested ω-OH fatty acid is a saturated ω-OH $C_{20}$ fatty acid or composition thereof. In yet another embodiment, additional saturated or unsaturated ω-OH fatty acids or compositions thereof are produced by the method described herein.

Another aspect of the present disclosure provides a CYP153A-reductase hybrid fusion polypeptide variant having at least about 90%, 91%, 93%, 94%, 95%, 96%, 97%, 98%, or 99% sequence identity to SEQ ID NO: 38 and having at least one or more mutations at an amino acid position including position 9, 10, 11, 12, 13, 14, 27, 28, 56, 61, 111, 119, 140, 149, 154, 157, 162, 164, 204, 231, 233, 244, 254, 271, 273, 302, 309, 327, 407, 413, 477, 480, 481, 527, 544, 546, 557, 567, 591, 648, 649, 703, 706, 707, 708, 709, 710, 719, 720, 736, 741, 745, 747, 749, 757, 770, 771, 784, wherein the CYP153A-reductase hybrid fusion polypeptide variant catalyzes the conversion of a fatty acid to an ω-OH fatty acid or composition thereof. The CYP153A-reductase hybrid fusion polypeptide variant has a mutation at any one or more of the following positions, including position D9N where aspartate (D) is substituted with (i.e., replaced with) asparagine (N); position D9K where aspartate (D) is substituted with lysine (K); position D10Y where aspartic acid (D) is substituted with tyrosine (Y); position I11L where isoleucine (I) is substituted with leucine (L); position Q12W where glutamine (Q) is substituted with tryptophan (W); position Q12R where glutamine (Q) is substituted with arginine (R); position Q12T where glutamine (Q) is substituted with threonine (T); position S13K where serine (S) is substituted with lysine (K); position R14F where arginine (R) is substituted with phenylalanine (F); position R27L where arginine (R) substituted with leucine (L); position Q28M where glutamine (Q) is substituted with methionine (M); position Q28T where glutamine (Q) is substituted with threonine (T); position P56Q where proline (P) is substituted with glutamine (Q); position N61L where asparagine (N) is substituted with leucine (L); position F11A where phenylalanine (F) is substituted with alanine (A); position K119R where lysine (K) is substituted with arginine (R); position S140N where serine (S) is substituted with asparagine (N); position P149G where proline (P) is substituted with glycine (G); position P149R where proline (P) is substituted with arginine (R); position V154G where valine (V) is substituted with glycine (G); position S157R where serine (S) is substituted with arginine (R); position V162C where valine (V) is substituted with cysteine (C); position A164N where alanine (A) is substituted with asparagine (N); position G204V where glycine (G) is substituted with valine (V); position A231W where alanine (A) is substituted with tryptophan (W); position A231Y where alanine (A) is substituted with tyrosine (Y); position A231V where alanine (A) is substituted with valine (V); position S233L where serine (S) is substituted with leucine (L); position S233V where serine (S) is substituted with valine (V); position A244R where alanine (A) is substituted with arginine (R); position R254G where arginine (R) is substituted with glycine (G); position E271D where glutamate (E) is substituted with aspartate (D); position P273M where proline (P) is substituted with methionine (M); position T302M where threonine (T) is substituted with methionine (M); position N309S where asparagine (N) is substituted with serine (S); position P327D where proline (P) is substituted with aspartate (D); position N407G where asparagine (N) is substituted with glycine (G); position Y413R where tyrosine (Y) is substituted with arginine (R); position V451M where valine (V) is substituted with methionine (M); position P477G where proline (P) is substituted with glycine (G); position I480G where isoleucine (I) is substituted with glycine (G); position G481I where glycine (G) is substituted with isoleucine (I); position D527E where aspartate (D) is substituted with glutamate (E); position D544N where aspartate (D) is substituted with asparagine (N); position P546G where proline (P) is substituted with glycine (G); position E557R where glutamate (E) is substituted with arginine (R); position E557W where glutamate (E) is substituted with tryptophan (W); position E567S where glutamate (E) is substituted with serine (S); position E591Q where glutamate (E) is substituted with glutamine (Q); position V648L where valine (V) is substituted with leucine (L); position S649I where serine (S) is substituted with isoleucine (I); position L703G where leucine (L) is substituted with glycine (G); position L706E where leucine (L) is substituted with glutamate (E); position L706S where leucine (L) is substituted with serine (S); position L706H where leucine (L) is substituted with histidine (H); position D707E where aspartate (D) is substituted with glutamate (E); position P708S where proline (P) is substituted with serine (S); position D709L where aspartate (D) is substituted with leucine (L); position V710C where valine (V) is substituted with cysteine (C); position V710R where valine (V) is substituted with arginine (R); position V710Q where valine (V) is substituted with glutamine (Q); position R719W where arginine (R) is substituted with tryptophan (W); position D720V where aspartate (D) is substituted with valine (V); position A736V where alanine (A) is substituted with valine (V); position N741G where asparagine (N) is substituted with glycine (G); position P745K where proline (P) is substituted with lysine (K); position P745R where proline (P) is substituted with arginine (R); position D747N where aspartate (D) is substituted with asparagine (N); position E749L where glutamate (E) is substituted with leucine (L); position E749M where glutamate (E) is substituted with methionine (M); position E757A where glutamate (E) is substituted with alanine (A); position T770G where threonine (T) is substituted with glycine (G); position V771F where valine (V) is substituted with phenylalanine (F); and position M784I where methionine (M) is substituted with isoleucine (I). In one embodiment, the CYP153A-reductase hybrid fusion polypeptide variant is a hybrid cyp153A-RedRhF-type fusion protein variant. In another embodiment, the CYP153A-reductase hybrid fusion polypeptide variant in a recombinant host cell results in a higher titer of an ω-OH fatty acid as compared to the titer of an ω-OH fatty acid produced by expression of a template CYP153A-reductase hybrid fusion polypeptide, e.g., the CYP153A-reductase hybrid fusion polypeptide of SEQ ID NO: 6 or SEQ ID NO: 38, in a corresponding host cell. In another embodiment, the ω-OH fatty acid is an ω-OH fatty acid composition.

Examples of CYP153A-reductase hybrid fusion polypeptide variants of the present disclosure are SEQ ID NOs: 47-164 as shown in Sequence Tables B and C.

Another aspect of the present disclosure provides a CYP153A-reductase hybrid fusion polypeptide variant having at least about 90%, 91%, 93%, 94%, 95%, 96%, 97%, 98%, or 99% sequence identity to SEQ ID NO: 38 and having at least one mutation at an amino acid position including position 747, 12, 327, 14, 61, 28, 13, 771, 119, 10, 11, 28, 231, 745, 9, 770, 413, 784, 749, 233, 757, and 703, wherein the CYP153A-reductase hybrid fusion polypeptide variant catalyzes the conversion of a fatty acid to an ω-OH fatty acid. The CYP153A-reductase hybrid fusion polypeptide variant has a mutation at any one or more of the following positions, including position D747N where aspartate (D) is substituted with asparagine (N); position Q12W where glutamine (Q) is substituted with tryptophan (W); position Q12R where glutamine (Q) is substituted with arginine (R); position Q12T where glutamine (Q) is substituted with threonine (T); position P327D where proline (P) is substituted with aspartate (D); position R14F where arginine (R) is substituted with phenylalanine (F); position N61L where asparagine (N) is substituted with leucine (L); position Q28M where glutamine (Q) is substituted with methionine (M); position S13K where serine (S) is substituted with lysine (K); position V771F where valine (V) is substituted with phenylalanine (F); position K119R where lysine (K) is substituted with arginine (R); position D10Y where aspartic acid (D) is substituted with tyrosine (Y); position I11L where isoleucine (I) is substituted with leucine (L); position Q28T where glutamine (Q) is substituted with threonine (T); position P745R where proline (P) is substituted with arginine (R); position D9N where aspartate (D) is substituted with asparagine (N); position D9K where aspartate (D) is substituted with lysine (K); position T770G where threonine (T) is substituted with glycine (G); position Y413R where tyrosine (Y) is substituted with arginine (R); position M784I where methionine (M) is substituted with isoleucine (I); position E749L where glutamate (E) is substituted with leucine (L); position S233L where serine (S) is substituted with leucine (L); position E757A where glutamate (E) is substituted with alanine (A); position L703G where leucine (L) is substituted with glycine (G); and position A231Y where alanine (A) is substituted with tyrosine (Y). In one embodiment, the CYP153A-reductase hybrid fusion polypeptide variant is a hybrid CYP153A-RedRhF-type fusion protein variant. In another embodiment, the CYP153A-reductase hybrid fusion polypeptide variant in a recombinant host cell results in a higher titer of an ω-OH fatty acid as compared to the titer of an ω-OH fatty acid produced by expression of a template CYP153A-reductase hybrid fusion polypeptide, e.g., the CYP153A-reductase hybrid fusion polypeptide of SEQ ID NO: 6 or SEQ ID NO: 38, in a corresponding host cell. In another embodiment, the CYP153A-reductase hybrid fusion polypeptide variants (and corresponding polynucleotide sequences) include SEQ ID NOs: 47-164 as shown in Sequence Tables B and C. In another embodiment, the ω-OH fatty acid is an ω-OH fatty acid composition.

Another aspect of the present disclosure provides a CYP153A-reductase hybrid fusion polypeptide variant having at least about 90%, 91%, 93%, 94%, 95%, 96%, 97%, 98%, or 99% sequence identity to SEQ ID NO: 98 and having at least one mutation at an amino acid position including position 12, 27, 119, 140, 157, 159, 233 and 244, wherein the CYP153A-reductase hybrid fusion polypeptide variant catalyzes the conversion of a fatty acid to an ω-OH fatty acid. In one embodiment, the CYP153A-reductase hybrid fusion polypeptide variant has a mutation at any one or more of the following positions, including position Q12W where glutamine (Q) is substituted with tryptophan (W); position R27L where arginine (R) is substituted with leucine (L); position K119R where lysine (K) is substituted with arginine (R); position S140N where serine (S) is substituted with asparagine (N); position S157R where serine (S) is substituted with arginine (R); position V159M where valine (V) is substituted with methionine (M); position S233L where serine (S) is substituted with leucine (L); and position A244R where alanine (A) is substituted with arginine (R).

Another aspect of the present disclosure provides a CYP153A-reductase hybrid fusion polypeptide variant having at least about 90%, 91%, 93%, 94%, 95%, 96%, 97%, 98%, or 99% sequence identity to SEQ ID NO: 100 and having at least one mutation at an amino acid position including position 12, 28, 61, 119, 231, 309, 413 and 480, wherein the CYP153A-reductase hybrid fusion polypeptide variant catalyzes the conversion of a fatty acid to an ω-OH fatty acid. The CYP153A-reductase hybrid fusion polypeptide variant has a mutation at any one or more of the following positions, including position Q12R where glutamine (Q) is substituted with arginine (R); position Q28M where glutamine (Q) is substituted with methionine (M); position N61L where asparagine (N) is substituted with leucine (L); position K119R where lysine (K) is substituted with arginine (R); position A231V where alanine (A) is substituted with valine (V); position N309S where asparagine (N) is substituted with serine (S); position Y413R where tyrosine (Y) is substituted with arginine (R); and position I480G where isoleucine (I) is substituted with glycine (G).

Another aspect of the present disclosure provides a CYP153A-reductase hybrid fusion polypeptide variant having at least about 80%, 81%, 82%, 83%, 84%, 85%, 86%, 87%, 88%, or 89% sequence identity to the amino acid sequence of SEQ ID NO: 38, wherein the CYP153A-reductase hybrid fusion polypeptide variant comprises a mutation at amino acid position 12 and a mutation at each of amino acid positions: (a) 27, 119, 140, 157, 159, 233, and 244 of SEQ ID NO: 38; (b) 28, 61, 119, 231, 309, 413, and 480 of SEQ ID NO: 38; (c) 119, 231, and 480 of SEQ ID NO: 38; (d) 28, 77, 119; 141, 231 and 407 of SEQ ID NO: 38; (e) 28, 61, 141, 231, and 407 of SEQ ID NO: 38; (f) 28, 119, 231, and 244 of SEQ ID NO: 38; (g) 28, 407, and 480 of SEQ ID NO: 38; (h) 141, 231, 413, and 481of SEQ ID NO: 38; (i) 28, 111, 231, and 407 of SEQ ID NO: 38; (j) 28, 61, 140, and 149 of SEQ ID NO: 38; (k) 28, 77, 119, 159, 231, 254, 407, and 480 of SEQ ID NO: 38; (l) 28, 254, 309, 407, and 451 of SEQ ID NO: 38; (m) 28, 254, 309, 407, and 480 of SEQ ID NO: 38; or (n) 28, 309, 407, 451, and 480 of SEQ ID NO: 38; wherein the CYP153A-reductase hybrid fusion polypeptide variant catalyzes the conversion of a fatty acid to an omega-hydroxylated fatty acid. Another aspect of the present disclosure provides a CYP153A-reductase hybrid fusion polypeptide variant having at least about 90%, 91%, 92%, 93%, 94%, 95%, 96%, 97%, 98%, or 99% sequence identity to the amino acid sequence of SEQ ID NO: 38, wherein the CYP153A-reductase hybrid fusion polypeptide variant comprises a mutation at amino acid position 12 and a mutation at each of amino acid positions: (a) 27, 119, 140, 157, 159, 233, and 244 of SEQ ID NO: 38; (b) 28, 61, 119, 231, 309, 413, and 480 of SEQ ID NO: 38; (c) 119, 231, and 480 of SEQ ID NO: 38; (d) 28, 77, 119; 141, 231 and 407 of SEQ ID NO: 38; (e) 28, 61, 141, 231, and 407 of SEQ ID NO: 38; (f) 28, 119, 231, and 244 of SEQ ID NO: 38; (g) 28, 407, and 480 of SEQ ID NO: 38; (h) 141, 231, 413, and 481of SEQ ID NO: 38; (i) 28, 111, 231, and 407 of SEQ ID NO: 38; (j) 28, 61, 140, and 149 of SEQ ID NO: 38; (k) 28, 77, 119, 159, 231, 254, 407, and 480 of SEQ ID NO: 38; (l) 28, 254, 309, 407, and 451 of SEQ ID NO: 38; (m) 28, 254, 309, 407, and 480 of SEQ ID NO: 38; or (n) 28, 309, 407, 451, and 480 of SEQ ID NO: 38; wherein the CYP153A-reductase hybrid fusion polypeptide variant catalyzes the conversion of a fatty acid to an omega-hydroxylated fatty acid. In various embodiments, the said mutations under (a) at amino acid positions 12, 27, 119, 140, 157, 159, 233, and 244 of SEQ ID NO: 38 are amino acid substitutions. In various embodiments, the said mutations under (b) at amino acid positions 12, 28, 61, 119, 231, 309, 413, and 480 of SEQ ID NO: 38 are amino acid substitutions. In various embodiments, the said mutations under (c) at amino acid positions 12, 119, 231, and 480 of SEQ ID NO: 38 are amino acid substitutions. In various embodiments, the said mutations under (d) at amino acid positions 12, 28, 77, 119; 141, 231 and 407 of SEQ ID NO: 38 are amino acid substitutions. In various embodiments, the said mutations under (e) at amino acid positions 12, 28, 61, 141, 231, and 407 of SEQ ID NO: 38 are amino acid substitutions. In various embodiments, the said mutations under (f) at amino acid positions 12, 28, 119, 231, and 244 of SEQ ID NO: 38 are amino acid substitutions. In various embodiments, the said mutations under (g) at amino acid positions 12, 28, 407, and 480 of SEQ ID NO: 38 are amino acid substitutions. In various embodiments, the said mutations under (h) at amino acid positions 12, 141, 231, 413, and 481 of SEQ ID NO: 38 are amino acid substitutions. In various embodiments, the said mutations under (i) at amino acid positions 12, 28, 111, 231, and 407 of SEQ ID NO: 38 are amino acid substitutions. In various embodiments, the said mutations under (j) at amino acid positions 12, 28, 61, 140, and 149 of SEQ ID NO: 38 are amino acid substitutions. In various embodiments, the said mutations under (k) at amino acid positions 12, 28, 77, 119, 159, 231, 254, 407, and 480 are amino acid substitutions. In various embodiments, the said mutations under (l) at amino acid positions 12, 28, 254, 309, 407, and 451 of SEQ ID NO: 38 are amino acid substitutions. In various embodiments, the said mutations under (m) at amino acid positions 12, 28, 254, 309, 407, and 480 of SEQ ID NO: 38 are amino acid substitutions. In various embodiments, the said mutations under (n) at amino acid positions 12, 28, 309, 407, 451, and 480 of SEQ ID NO: 38 are amino acid substitutions. In one embodiment, the said mutations under (a) at amino acid positions 12, 27, 119, 140, 157, 159, 233, and 244 of SEQ ID NO: 38 are Q12W, R27L, K119R, S140N, S157R, V159M, S233L, and A244R, respectively. In one embodiment, the said mutations under (b) at amino acid positions 12, 28, 61, 119, 231, 309, 413, and 480 of SEQ ID NO: 38 are Q12R, Q28M, N61L, K119R, A231V, N309S, Y413R, and I480G, respectively. In one embodiment, the said mutations under (c) at amino acid positions 12, 119, 231, and 480 of SEQ ID NO: 38 are Q12R, K119R, A231V, and I480G, respectively. In one embodiment, the said mutations under (d) at amino acid positions 12, 28, 77, 119; 141, 231 and 407 of SEQ ID NO: 38 are Q12T, Q28M, R77Q, K119R, V141T, A231W and N407G, respectively. In one embodiment, the said mutations under (e) at amino acid positions 12, 28, 61, 141, 231, and 407 of SEQ ID NO: 38 are Q12R, Q28M, N61L, V141T, A231Y, and N407G, respectively. In one embodiment, the said mutations under (f) at amino acid positions 12, 28, 119, 231, and 244 of SEQ ID NO: 38 are Q12W, Q28M, K119R, A231Y, and A244R, respectively. In one embodiment, the said mutations under (g) at amino acid positions 12, 28, 407, and 480 of SEQ ID NO: 38 are Q12W, Q28T, N407G, and I480G, respectively. In one embodiment, the said mutations under (h) at amino acid positions 12, 141, 231, 413, and 481 of SEQ ID NO: 38 are Q12R, V141T, A231Y, Y413R, and G481I, respectively. In one embodiment, the said mutations under (i) at amino acid positions 12, 28, 111, 231, and 407 of SEQ ID NO: 38 are Q12T, Q28M, F111A, A231V, and N407G, respectively. In one embodiment, the said mutations under (j) at amino acid positions 12, 28, 61, 140, and 149 of SEQ ID NO: 38 are Q12T, Q28M, N61L, S140N, and P149R, respectively. In one embodiment, the said mutations under (k) at amino acid positions 12, 28, 77, 119, 159, 231, 254, 407, and 480 are Q12W, Q28T, R77Q, K119R, V159M, A231Y, R254G, N407G, and I480G, respectively. In one embodiment, the said mutations under (l) at amino acid positions 12, 28, 254, 309, 407, and 451 of SEQ ID NO: 38 are Q12W, Q28T, R254G, N309S, N407G, and V451M, respectively. In one embodiment, the said mutations under (m) at amino acid positions 12, 28, 254, 309, 407, and 480 of SEQ ID NO: 38 are Q12W, Q28T, R254G, N309S, N407G, and I480G, respectively. In one embodiment, the said mutations under (n) at amino acid positions 12, 28, 309, 407, 451, and 480 of SEQ ID NO: 38 are Q12W, Q28T, N309S, N407G, V451M, and I480G, respectively. In one preferred embodiment, the CYP153A-reductase hybrid fusion polypeptide variant of the above (a) further comprises a mutation at each of amino acid positions 141, 231 and 407 of SEQ ID NO: 38, or at each of amino acid positions 231, 407, 451, 757, 770 and 784 of SEQ ID NO: 38, or at each of amino acid positions 231, 407, 591, 643, 757 and 784 of SEQ ID NO: 38. In various embodiments, the said further mutations at each of amino acid positions 141, 231 and 407 of SEQ ID NO: 38 are amino acid substitutions. Also, in various embodiments the said further mutations at each of amino acid positions 231, 407, 451, 757, 770 and 784 of SEQ ID NO: 38 are amino acid substitutions. Also, in various embodiments the said further mutations at each of amino acid positions 231, 407, 591, 643, 757 and 784 of SEQ ID NO: 38 are amino acid substitutions. Preferably, the said further mutations at each of amino acid positions 141, 231 and 407 of SEQ ID NO: 38 are V141T, A231Y and N407G, respectively. Also, preferably the said mutations at each of amino acid positions 231, 407, 451, 757, 770 and 784 of SEQ ID NO: 38 are A231Y, N407G, V451M, E757A, T770G and M784I, respectively. Also, preferably the said mutations at each of amino acid positions 231, 407, 591, 643, 757 and 784 of SEQ ID NO: 38 are A231Y, N407G, E591Q, R643H, E757A and M784I, respectively. More preferably, the CYP153A-reductase hybrid fusion polypeptide variant of the present disclosure comprises the amino acid sequence of SEQ ID NO: 146, SEQ ID NO: 150, or SEQ ID NO: 160. In other embodiments of the present disclosure the CYP153A-reductase hybrid fusion polypeptide variant comprises the amino acid sequence of any one of SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, and SEQ ID NO: 124.

In another aspect, the present disclosure provides a CYP153A-reductase hybrid fusion polypeptide variant comprising at least about 80%, 81%, 82%, 83%, 84%, 85%, 86%, 87%, 88%, or 89% sequence identity to the amino acid sequence of SEQ ID NO: 38, wherein the CYP153A-reductase hybrid fusion polypeptide variant comprises a mutation in the RhF domain (or RhF reductase domain, or Red450RhF domain, or Red450RhF reductase domain, or P450RhF domain, or P450RhF reductase domain) at each of amino acid positions (a) 527, 544, 719, 757, 771, and 784 of SEQ ID NO: 38; (b) 527, 544, and 557 of SEQ ID NO: 38; (c) 770 and 784 of SEQ ID NO: 38; (d) 527, 591, 648, 719, 757, 771, and 784 of SEQ ID NO: 38; (e) 527, 591, 648, 757, and 771 of SEQ ID NO: 38; (f) 527, 544, 770, and 784 of SEQ ID NO: 38; (g) 527, 557, 770, and 784 of SEQ ID NO: 38; (h) 557, 757, and 770 of SEQ ID NO: 38; (i) 557, 757, and 771 of SEQ ID NO: 38; or (j) 757 and 770 of SEQ ID NO: 38; wherein the CYP153A-reductase hybrid fusion polypeptide variant catalyzes the conversion of a fatty acid to an omega-hydroxylated fatty acid. In another aspect, the present disclosure provides a CYP153A-reductase hybrid fusion polypeptide variant comprising at least about 90%, 91%, 92%, 93%, 94%, 95%, 96%, 97%, 98%, or 99% sequence identity to the amino acid sequence of SEQ ID NO: 38, wherein the CYP153A-reductase hybrid fusion polypeptide variant comprises a mutation in the RhF domain (or RhF reductase domain, or Red450RhF domain, or Red450RhF reductase domain, or P450RhF domain, or P450RhF reductase domain) at each of amino acid positions (a) 527, 544, 719, 757, 771, and 784 of SEQ ID NO: 38; (b) 527, 544, and 557 of SEQ ID NO: 38; (c) 770 and 784 of SEQ ID NO: 38; (d) 527, 591, 648, 719, 757, 771, and 784 of SEQ ID NO: 38; (e) 527, 591, 648, 757, and 771 of SEQ ID NO: 38; (f) 527, 544, 770, and 784 of SEQ ID NO: 38; (g) 527, 557, 770, and 784 of SEQ ID NO: 38; (h) 557, 757, and 770 of SEQ ID NO: 38; (i) 557, 757, and 771 of SEQ ID NO: 38; or (j) 757 and 770 of SEQ ID NO: 38; wherein the CYP153A-reductase hybrid fusion polypeptide variant catalyzes the conversion of a fatty acid to an omega-hydroxylated fatty acid. In various embodiments, the said mutations under under (a) at amino acid positions 527, 544, 719, 757, 771, and 784 of SEQ ID NO: 38 are amino acid substitutions. In various embodiments, the said mutations under (b) at amino acid positions 527, 544, and 557 of SEQ ID NO: 38 are amino acid substitutions. In various embodiments, the said mutations under (c) at amino acid positions 770 and 784 of SEQ ID NO: 38 are amino acid substitutions. In various embodiments, the said mutations under (d) at amino acid positions 527, 591, 648, 719, 757, 771, and 784 of SEQ ID NO: 38 are amino acid substitutions. In various embodiments, the said mutations under (e) at amino acid positions 527, 591, 648, 757, and 771 of SEQ ID NO: 38 are amino acid substitutions. In various embodiments, the said mutations under (f) at amino acid positions 527, 544, 770, and 784 of SEQ ID NO: 38 are amino acid substitutions. In various embodiments, the said mutations under (g) at amino acid positions 527, 557, 770, and 784 of SEQ ID NO: 38 are amino acid substitutions. In various embodiments, the said mutations under (h) at amino acid positions 557, 757, and 770 of SEQ ID NO: 38 are amino acid substitutions. In various embodiments, the said mutations under (i) at amino acid positions 557, 757, and 771 of SEQ ID NO: 38 are amino acid substitutions. In various embodiments, the said mutations under (j) at amino acid positions 757 and 770 of SEQ ID NO: 38 are amino acid substitutions. In one embodiment, the said mutations under under (a) at amino acid positions 527, 544, 719, 757, 771, and 784 of SEQ ID NO: 38 are D527E, D544N, R719W, E757A, V771F, and M784I, respectively. In one embodiment, the said mutations under (b) at amino acid positions 527, 544, and 557 of SEQ ID NO: 38 are D527E, D544N, and E557R, respectively. In one embodiment, the said mutations under (c) at amino acid positions 770 and 784 of SEQ ID NO: 38 are T770G and M784I, respectively. In one embodiment, the said mutations under (d) at amino acid positions 527, 591, 648, 719, 757, 771, and 784 of SEQ ID NO: 38 are D527E, E591Q, V648L, R719W, E757A, V771F, and M784I, respectively. In one embodiment, the said mutations under (e) at amino acid positions 527, 591, 648, 757, and 771 of SEQ ID NO: 38 are D527E, E591Q, V648L, E757A, and V771F, respectively. In one embodiment, the said mutations under (f) at amino acid positions 527, 544, 770, and 784 of SEQ ID NO: 38 are D527E, D544N, T770G, and M784I, respectively. In one embodiment, the said mutations under (g) at amino acid positions 527, 557, 770, and 784 of SEQ ID NO: 38 are D527E, E557R, T770G, and M784I, respectively. In one embodiment, the said mutations under (h) at amino acid positions 557, 757, and 770 of SEQ ID NO: 38 are E557W, E757A, and T770G, respectively. In one embodiment, the said mutations under (i) at amino acid positions 557, 757, and 771 of SEQ ID NO: 38 are E557R, E757A, and V771F, respectively. In one embodiment, the said mutations under (j) at amino acid positions 757 and 770 of SEQ ID NO: 38 are E757A and T770G, respectively. In some preferred embodiments of the present disclosure, the CYP153A-reductase hybrid fusion polypeptide variant comprises the amino acid sequence of any one of SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, and SEQ ID NO: 144.

In still another aspect, the present disclosure provides a CYP153A-reductase hybrid fusion polypeptide variant comprising at least about 90%, 91%, 92%, 93%, 94%, 95%, 96%, 97%, 98%, or 99% sequence identity to the amino acid sequence of SEQ ID NO: 38, wherein the CYP153A-reductase hybrid fusion polypeptide variant comprises a mutation at each of positions (a) 141, 231, 233, and 254 of SEQ ID NO: 38; (b) 141, 231, 233, and 244 of SEQ ID NO: 38; (c) 141, 231, 244, 451, 557, 749, and 770 of SEQ ID NO: 38; (d) 27, 28, 61, 141, 149, and 231 of SEQ ID NO: 38; (e) 141, 157, 231, 233, 244, 757, and 784 of SEQ ID NO: 38; (f) 28, 61, 140, 141, 231, 233, and 271 of SEQ ID NO: 38; or (g) 231, 233, 254, and 557 of SEQ ID NO: 38; wherein the CYP153A-reductase hybrid fusion polypeptide variant catalyzes the conversion of a fatty acid to an omega-hydroxylated fatty acid. In still another aspect, the present disclosure provides a CYP153A-reductase hybrid fusion polypeptide variant comprising at least about 80%, 81%, 82%, 83%, 84%, 85%, 86%, 87%, 88%, or 89% sequence identity to the amino acid sequence of SEQ ID NO: 38, wherein the CYP153A-reductase hybrid fusion polypeptide variant comprises a mutation at each of positions (a) 141, 231, 233, and 254 of SEQ ID NO: 38; (b) 141, 231, 233, and 244 of SEQ ID NO: 38; (c) 141, 231, 244, 451, 557, 749, and 770 of SEQ ID NO: 38; (d) 27, 28, 61, 141, 149, and 231 of SEQ ID NO: 38; (e) 141, 157, 231, 233, 244, 757, and 784 of SEQ ID NO: 38; (f) 28, 61, 140, 141, 231, 233, and 271 of SEQ ID NO: 38; or (g) 231, 233, 254, and 557 of SEQ ID NO: 38; wherein the CYP153A-reductase hybrid fusion polypeptide variant catalyzes the conversion of a fatty acid to an omega-hydroxylated fatty acid. In various embodiments, the said mutations under (a) at amino acid positions 141, 231, 233, and 254 of SEQ ID NO: 38 are amino acid substitutions. In various embodiments, the said mutations under (b) at amino acid positions 141, 231, 233, and 244 of SEQ ID NO: 38 are amino acid substitutions. In various embodiments, the said mutations under (c) at amino acid positions 141, 231, 244, 451, 557, 749, and 770 of SEQ ID NO: 38 are amino acid substitutions. In various embodiments, the said mutations under (d) at amino acid positions 27, 28, 61, 141, 149, and 231 of SEQ ID NO: 38 are amino acid substitutions. In various embodiments, the said mutations under (e) at amino acid positions 141, 157, 231, 233, 244, 757, and 784 of SEQ ID NO: 38 are amino acid substitutions. In various embodiments, the said mutations under (f) at amino acid positions 28, 61, 140, 141, 231, 233, and 271 of SEQ ID NO: 38 are amino acid substitutions. In various embodiments, the said mutations under (g) at amino acid positions 231, 233, 254, and 557 of SEQ ID NO: 38 are amino acid substitutions. In one embodiment, the said mutations under (a) at amino acid positions 141, 231, 233, and 254 of SEQ ID NO: 38 are V141T, A231Y, L233S, and R254G, respectively. In one embodiment, the said mutations under (b) at amino acid positions 141, 231, 233, and 244 of SEQ ID NO: 38 are V141T, A231Y, L233S, and R244A, respectively. In one embodiment, the said mutations under (c) at amino acid positions 141, 231, 244, 451, 557, 749, and 770 of SEQ ID NO: 38 are V141T, A231Y, R244A, V451M, E557W, E749L, and T770G, respectively. In one embodiment, the said mutations under (d) at amino acid positions 27, 28, 61, 141, 149, and 231 of SEQ ID NO: 38 are L27R, Q28M, N61L, V141T, P149G, and A231Y, respectively. In one embodiment, the said mutations under (e) at amino acid positions 141, 157, 231, 233, 244, 757, and 784 of SEQ ID NO: 38 are V141T, R157S, A231Y, L233S, R244A, E757A, and M784I, respectively. In one embodiment, the said mutations under (f) at amino acid positions 28, 61, 140, 141, 231, 233, and 271 of SEQ ID NO: 38 are Q28M, N61L, N140S, V141T, A231Y, L233S, and E271D, respectively. In one embodiment, the said mutations under (g) at amino acid positions 231, 233, 254, and 557 of SEQ ID NO: 38 are A231Y, L233S, R254G, and E557W, respectively. In some preferred embodiments of the present disclosure, the CYP153A-reductase hybrid fusion polypeptide variant of the present disclosure comprises the amino acid sequence of any one of SEQ ID NO: 148, SEQ ID NO: 152, SEQ ID NO: 154, SEQ ID NO: 156, SEQ ID NO: 158, SEQ ID NO: 162, and SEQ ID NO: 164.

In still another aspect, the present disclosure provides a CYP153A-reductase hybrid fusion polypeptide variant comprising at least about 80%, 81%, 82%, 83%, 84%, 85%, 86%, 87%, 88%, or 89% sequence identity to the amino acid sequence of SEQ ID NO: 98, wherein the CYP153A-reductase hybrid fusion polypeptide variant comprises a mutation at each of amino acid positions (a) 141, 231, and 407 of SEQ ID NO: 98; (b) 141, 231, 233, and 254 of SEQ ID NO: 98; (c) 231, 407, 451, 757, 770, and 784 of SEQ ID NO: 98; (d) 141, 231, 233, and 244 of SEQ ID NO: 98; (e) 141, 231, 244, 451, 557, 749, and 770 of SEQ ID NO: 98; (f) 27, 28, 61, 141, 149, and 231 of SEQ ID NO: 98; (g) 27, 119, 140, 141, 159, 231, 757, and 784 of SEQ ID NO: 98; (h) 231, 407, 591, 643, 757, and 784 of SEQ ID NO: 98; (i) 28, 61, 140, 141, 231, 233, and 271 of SEQ ID NO: 98; or (j) 231, 233, and 254 of SEQ ID NO: 98; wherein the CYP153A-reductase hybrid fusion polypeptide variant catalyzes the conversion of a fatty acid to an omega-hydroxylated fatty acid. In still another aspect, the present disclosure provides a CYP153A-reductase hybrid fusion polypeptide variant comprising at least about 90%, 91%, 92%, 93%, 94%, 95%, 96%, 97%, 98%, or 99% sequence identity to the amino acid sequence of SEQ ID NO: 98, wherein the CYP153A-reductase hybrid fusion polypeptide variant comprises a mutation at each of amino acid positions (a) 141, 231, and 407 of SEQ ID NO: 98; (b) 141, 231, 233, and 254 of SEQ ID NO: 98; (c) 231, 407, 451, 757, 770, and 784 of SEQ ID NO: 98; (d) 141, 231, 233, and 244 of SEQ ID NO: 98; (e) 141, 231, 244, 451, 557, 749, and 770 of SEQ ID NO: 98; (f) 27, 28, 61, 141, 149, and 231 of SEQ ID NO: 98; (g) 27, 119, 140, 141, 159, 231, 757, and 784 of SEQ ID NO: 98; (h) 231, 407, 591, 643, 757, and 784 of SEQ ID NO: 98; (i) 28, 61, 140, 141, 231, 233, and 271 of SEQ ID NO: 98; or (j) 231, 233, and 254 of SEQ ID NO: 98; wherein the CYP153A-reductase hybrid fusion polypeptide variant catalyzes the conversion of a fatty acid to an omega-hydroxylated fatty acid. In various embodiments, the said mutations under (a) at amino acid positions 141, 231, and 407 of SEQ ID NO: 98 are amino acid substitutions. In various embodiments, the said mutations under (b) at amino acid positions 141, 231, 233, and 254 of SEQ ID NO: 98 are amino acid substitutions. In various embodiments, the said mutations under (c) at amino acid positions 231, 407, 451, 757, 770, and 784 of SEQ ID NO: 98 are amino acid substitutions. In various embodiments, the said mutations under (d) at amino acid positions 141, 231, 233, and 244 of SEQ ID NO: 98 are amino acid substitutions. In various embodiments, the said mutations under (e) at amino acid positions 141, 231, 244, 451, 557, 749, and 770 of SEQ ID NO: 98 are amino acid substitutions. In various embodiments, the said mutations under (f) at amino acid positions 27, 28, 61, 141, 149, and 231 of SEQ ID NO: 98 are amino acid substitutions. In various embodiments, the said mutations under (g) at amino acid positions 27, 119, 140, 141, 159, 231, 757, and 784 of SEQ ID NO: 98 are amino acid substitutions. In various embodiments, the said mutations under (h) at amino acid positions 231, 407, 591, 643, 757, and 784 of SEQ ID NO: 98 are amino acid substitutions. In various embodiments, the said mutations under (i) at amino acid positions 28, 61, 140, 141, 231, 233, and 271 of SEQ ID NO: 98 are amino acid substitutions. In various embodiments, the said mutations under (j) at amino acid positions 231, 233, and 254 of SEQ ID NO: 38 are amino acid substitutions. In one embodiment, the said mutations under (a) at amino acid positions 141, 231, and 407 of SEQ ID NO: 98 are V141T, A231Y and N407G, respectively. In one embodiment, the said mutations under (b) at amino acid positions 141, 231, 233, and 254 of SEQ ID NO: 98 are V141T, A231Y, L233S, and R254G, respectively. In one embodiment, the said mutations under (c) at amino acid positions 231, 407, 451, 757, 770, and 784 of SEQ ID NO: 98 are A231Y, N407G, V451M, E757A, T770G and M784I, respectively. In one embodiment, the said mutations under (d) at amino acid positions 141, 231, 233, and 244 of SEQ ID NO: 98 are V141T, A231Y, L233S, and R244A, respectively. In one embodiment, the said mutations under (e) at amino acid positions 141, 231, 244, 451, 557, 749, and 770 of SEQ ID NO: 98 are V141T, A231Y, R244A, V451M, E557W, E749L, and T770G, respectively. In one embodiment, the said mutations under (f) at amino acid positions 27, 28, 61, 141, 149, and 231 of SEQ ID NO: 98 are L27R, Q28M, N61L, V141T, P149G, and A231Y, respectively. In one embodiment, the said mutations under (g) at amino acid positions 141, 157, 231, 233, 244, 757, and 784 of SEQ ID NO: 98 are V141T, R157S, A231Y, L233S, R244A, E757A, and M784I, respectively. In one embodiment, said mutations under (h) at amino acid positions 231, 407, 591, 643, 757, and 784 of SEQ ID NO: 98 are A231Y, N407G, E591Q, R643H, E757A and M784I, respectively. In one embodiment, the said mutations under (i) at amino acid positions 28, 61, 140, 141, 231, 233, and 271 of SEQ ID NO: 98 are Q28M, N61L, N140S, V141T, A231Y, L233S, and E271D, respectively. In one embodiment, the said mutations under (j) at amino acid positions 231, 233, 254, and 557 of SEQ ID NO: 98 are A231Y, L233S, R254G, and E557W, respectively. In some preferred embodiments of the present disclosure, the CYP153A-reductase hybrid fusion polypeptide variant of the present disclosure comprises the amino acid sequence of any one of SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160; SEQ ID NO: 162, and SEQ ID NO: 164.

In another aspect, the present disclosure provides a CYP153A-reductase hybrid fusion polypeptide variant comprising at least about 90%, 91%, 92%, 93%, 94%, 95%, 96%, 97%, 98%, or 99% sequence identity to the amino acid sequence of SEQ ID NO: 38 or SEQ ID NO: 98, wherein said CYP153A-reductase hybrid fusion polypeptide variant comprises one or more mutation(s) at positions 10, 11, 12, 27, 28, 111, 119, 140, 141, 149, 157, 159, 197, 231, 233, 244, 254, 407 and 477. The CYP153A-reductase hybrid fusion polypeptide variant catalyzes the conversion of a fatty acid to an omega-hydroxylated fatty acid. In still another aspect, the present disclosure provides a CYP153A-reductase hybrid fusion polypeptide variant comprising at least about 80%, 81%, 82%, 83%, 84%, 85%, 86%, 87%, 88%, or 89% sequence identity to the amino acid sequence of SEQ ID NO: 38 or SEQ ID NO: 98, wherein the CYP153A-reductase hybrid fusion polypeptide variant comprises one or more mutations including (a) Q12W, R27L, Q28M, K119R, V141T, S157R, V159M, A231Y, S233L, A244R (SEQ ID NO: 166); (b) Q12W, Q28M, K119R, S140N, S157R, V159M, S233L, A244R, R254G, N407G (SEQ ID NO: 168); (c) Q12W, R27L, F111A, K119R, V141T, S157R, V159M, A231Y, S233L, A244R, R254G (SEQ ID NO: 170); (d) Q12W, Q28M, K119R, S140N, P149G, S157R, V159M, A231Y, S233L, N407G (SEQ ID NO: 172); (e) Q12W, R27L, Q28M, K119R, S140N, S157R, V159M, S233L, A244R, N407G (SEQ ID NO: 174); (f) D10Y, I11L, Q12W, Q28M, K119R, V141T, V159M, A231Y, S233L, A244R, N407G (SEQ ID NO: 176); (g) I11L, Q12W, R27L, Q28M, K119R, V141T, S157R, V159M, A197T, A231Y, S233L, A244R, N407G, P477G (SEQ ID NO: 178); (h) I11L, Q12W, Q28M, K119R, V141T, S157R, V159M, A197T, A231Y, S233L, A244R, N407G (SEQ ID NO: 180); and (i) I11L, Q12W, R27L, Q28M, K119R, V141T, P149G, S157R, V159M, A231Y, S233L, N407G (SEQ ID NO: 182). In various embodiments, the said mutations under (a)-(i) are amino acid substitutions. In some preferred embodiments of the present disclosure, the CYP153A-reductase hybrid fusion polypeptide variant of the present disclosure comprises the amino acid sequence of any one of SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180 and SEQ ID NO: 182.

The present disclosure contemplates a CYP153A-reductase hybrid fusion polypeptide variant having at least 90% sequence identity to the amino acid sequence of SEQ ID NO: 38, wherein the CYP153A-reductase hybrid fusion polypeptide variant has a mutation at amino acid position 12 and a mutation at each of amino acid positions (a) 12, 27, 28, 119, 141, 157, 159, 231, 233, and 244 of SEQ ID NO: 38; (b) 12, 28, 119, 140, 157, 159, 233, 244, 254, and 407 of SEQ ID NO: 38; (c) 12, 27, 111, 119, 141, 157, 159, 231, 233, 244, and 254 of SEQ ID NO: 38; (d) 12, 28, 119, 140, 149, 157, 159, 231, 233, and 407 of SEQ ID NO: 38; (e) 12, 27, 28, 119, 140, 157, 159, 233, 244, and 407 of SEQ ID NO: 38; (f) 10, 11, 12, 28, 119, 141, 159, 231, 233, 244, and 407 of SEQ ID NO: 38; (g) 11, 12, 27, 28, 119, 141, 157, 159, 197, 231, 233, 244, 407, and 477 of SEQ ID NO: 38; (h) 11, 12, 28, 119, 141, 157, 159, 197, 231, 233, 244, and 407 of SEQ ID NO: 38; or (i) 11, 12, 27, 28, 119, 141, 149, 157, 159, 231, 233, and 407 of SEQ ID NO: 38; wherein the CYP153A-reductase hybrid fusion polypeptide variant catalyzes the conversion of a fatty acid to an omega-hydroxylated fatty acid.

In one particular aspect, the present disclosure provides a CYP153A-reductase hybrid fusion polypeptide variant of claim 1, wherein: (a) the said mutations at amino acid positions 12, 27, 28, 119, 141, 157, 159, 231, 233, and 244 of SEQ ID NO: 38 are Q12W, R27L, Q28M, K119R, V141T, S157R, V159M, A231Y, S233L, and A244R, respectively; (b) the said mutations at amino acid positions 12, 28, 119, 140, 157, 159, 233, 244, 254, and 407 of SEQ ID NO: 38 are Q12W, Q28M, K119R, S140N, S157R, V159M, S233L, A244R, R254G, and N407G, respectively; (c) the said mutations at amino acid positions 12, 27, 111, 119, 141, 157, 159, 231, 233, 244, and 254 of SEQ ID NO: 38 are Q12W, R27L, F111A, K119R, V141T, S157R, V159M, A231Y, S233L, A244R, and R254G, respectively; (d) the said mutations at amino acid positions 12, 28, 119, 140, 149, 157, 159, 231, 233, and 407 of SEQ ID NO: 38 are Q12W, Q28M, K119R, S140N, P149G, S157R, V159M, A231Y, S233L, and N407G, respectively; (e) the said mutations at amino acid positions 12, 27, 28, 119, 140, 157, 159, 233, 244, and 407 of SEQ ID NO: 38 are Q12W, R27L, Q28M, K119R, S140N, S157R, V159M, S233L, A244R, and N407G, respectively; (f) the said mutations at amino acid positions 10, 11, 12, 28, 119, 141, 159, 231, 233, 244, and 407 of SEQ ID NO: 38 are D10Y, I11L, Q12W, Q28M, K119R, V141T, V159M, A231Y, S233L, A244R, and N407G, respectively; (g) the said mutations at amino acid positions 11, 12, 27, 28, 119, 141, 157, 159, 197, 231, 233, 244, 407, and 477 of SEQ ID NO: 38 are I11L, Q12W, R27L, Q28M, K119R, V141T, S157R, V159M, A197T, A231Y, S233L, A244R, N407G, and P477G, respectively; (h) the said mutations at amino acid positions 11, 12, 28, 119, 141, 157, 159, 197, 231, 233, 244, and 407 of SEQ ID NO: 38 are I11L, Q12W, Q28M, K119R, V141T, S157R, V159M, A197T, A231Y, S233L, A244R, and N407G, respectively; and (i) the said mutations at amino acid positions 11, 12, 27, 28, 119, 141, 149, 157, 159, 231, 233, and 407 of SEQ ID NO: 38 are I11L, Q12W, R27L, Q28M, K119R, V141T, P149G, S157R, V159M, A231Y, S233L, and N407G, respectively.

In another aspect, the disclosure provides a CYP153A-reductase hybrid fusion polypeptide variant of claim 2, wherein: (a) the CYP153A-reductase hybrid fusion polypeptide variant of (a) has the amino acid sequence of SEQ ID NO: 166; (b) the CYP153A-reductase hybrid fusion polypeptide variant of (b) has the amino acid sequence of SEQ ID NO: 168; (c) the CYP153A-reductase hybrid fusion polypeptide variant of (c) has the amino acid sequence of SEQ ID NO: 170; (d) the CYP153A-reductase hybrid fusion polypeptide variant of (d) has the amino acid sequence of SEQ ID NO: 172; (e) the CYP153A-reductase hybrid fusion polypeptide variant of (e) has the amino acid sequence of SEQ ID NO: 174; (f) the CYP153A-reductase hybrid fusion polypeptide variant of (f) has the amino acid sequence of SEQ ID NO: 176; (g) the CYP153A-reductase hybrid fusion polypeptide variant of (g) has the amino acid sequence of SEQ ID NO: 178; (h) the CYP153A-reductase hybrid fusion polypeptide variant of (h) has the amino acid sequence of SEQ ID NO: 180; and (i) the CYP153A-reductase hybrid fusion polypeptide variant of (i) has the amino acid sequence of SEQ ID NO: 182.

In one embodiment, the CYP153A-reductase hybrid fusion polypeptide variant includes, but is not limited to, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, and SEQ ID NO: 182. In another embodiment, the expression of the CYP153A-reductase hybrid fusion polypeptide variant in a recombinant host cell results in a higher titer of an omega-hydroxylated fatty acid as compared to the titer of an omega-hydroxylated fatty acid produced by expression of the CYP153A-reductase hybrid fusion polypeptide of SEQ ID NO: 6 or SEQ ID NO: 38 in a corresponding host cell. In another embodiment, the CYP153A-reductase hybrid fusion polypeptide variant is a hybrid CYP153A-RedRhF fusion protein variant. In another embodiment, a recombinant host cell expresses the CYP153A-reductase hybrid fusion polypeptide variant of the present disclosure. In still another embodiment, the recombinant host cell further expresses a thioesterase polypeptide of EC 3.1.2.-, EC 3.1.1.5 or EC 3.1.2.14. In yet another embodiment, the the recombinant host cell produces a omega-hydroxylated fatty acid composition with a titer that is at least 10% greater, at least 15% greater, at least 20% greater, at least 25% greater, or at least 30% greater than the titer of an omega-hydroxylated fatty acid composition produced by a host cell expressing a corresponding CYP153A-reductase hybrid fusion polypeptide having SEQ ID NO: 38 or SEQ ID NO: 6, when cultured in medium containing a carbon source. In another embodiment, the present disclosure provides a cell culture that includes the recombinant host cell as contemplated above.

In another aspect, the present disclosure provides a method of producing an omega-hydroxylated fatty acid, the steps including: (i) culturing a recombinant host cell or the cell culture in the presence of a carbon source; and (ii) harvesting an omega-hydroxylated fatty acid.

The disclosure further contemplates recombinant microorganism comprising a pathway engineered to express at least two nucleic acid sequences encoding a polypeptide including: (i) a thioesterase of EC 3.1.2.-, EC 3.1.1.5, or EC 3.1.2.14; and (ii) a CYP153A-reductase hybrid fusion polypeptide variant.

A CYP153A-reductase hybrid fusion polypeptide variant of the present disclosure comprises a CYP153A ω-hydroxylase domain and a P450RhF reductase domain. The order of the two domains is not limited to the order shown in FIG. 5. The CYP153A ω-hydroxylase domain may be at the N-terminus or may be at the C-terminus of the hybrid fusion polypeptide variant. Also, the P450RhF reductase domain may be at the N-terminus or may be at the C-terminus of the hybrid fusion polypeptide variant. The two domains may be linked either directly or by a linker as shown in FIG. 5. In various embodiments, the linker is a peptide or polypeptide linker. The length of the amino acid sequence of the linker can be selected empirically or with guidance from structural information or by using a combination of the two approaches. Those skilled in the art will recognize that there are many such sequences that vary in length or composition that can serve as linkers with the primary consideration being that they be neither excessively long nor short.

A CYP153A-reductase hybrid fusion polypeptide variant of the present disclosure comprises a CYP153A ω-hydroxylase domain and a P450RhF reductase domain as mentioned above. The amino acid sequence of the CYP153A-reductase hybrid fusion polypeptide of SEQ ID NO: 6 has one mutation, namely a mutation at position 307 (G307A), where an alanine (A) was substituted with (i.e., replaced with) a glycine (G). The amino acid sequence of the CYP153A-reductase hybrid fusion polypeptide of SEQ ID NO: 38 corresponds to the amino acid sequence of the CYP153A-reductase hybrid fusion polypeptide of SEQ ID NO: 6, except for having one additional mutation, namely a mutation at position 796 (A796V), where alanine (A) is substituted with (i.e., replaced with) valine (V).

As (template) CYP153A-reductase hybrid fusion polypeptide, one may consider a hybrid fusion protein, in which a CYP153A P450 oxygenase is fused with a reductase domain for producing omega-hydroxy fatty acid derivatives. Self-sufficient cytochrome P450 oxygenases are enzymes in which the reductase partner is fused to the cytochrome P450 catalytic protein. One class of self-sufficient bacterial cytochrome P450 oxygenases is represented by P450RhF from *Rhodococcus* sp. NCIMB 9784 (Roberts et al. (2003) *J. Biol. Chem.* 278: 48914; Hunter et al. (2005) FEBS Lett. 579: 2215) and is referred to as "Class-I P450-fused PFOR" (DeMot and Parret (2002) Trends Microbiol. 10: 502). Thus, as (template) CYP153A-reductase hybrid fusion polypeptide, one may consider a fusion protein comprising a CYP153A P450 catalytic protein (e.g., from *Marinobacter aquaeoli*) and the c-terminal FMN- and Fe/S-containing reductase domain of P450RhF from *Rhodococcus* sp. NCIMB9784.

In various embodiments of the present disclosure, the hybrid fusion polypeptide variant is self-sufficient and possesses ω-hydroxylase enzymatic activity that catalyzes the reaction of a fatty acid (derivative) to an ω-OH fatty acid or ω-OH fatty acid derivative.

In one aspect, the present disclosure encompasses a recombinant microorganism or recombinant host cell for producing an ω-OH fatty acid or ω-OH fatty acid derivative in vivo when grown in a fermentation broth in a presence of a carbon source from a renewable feedstock, the microorganism having a pathway engineered to express at least two nucleic acid sequences encoding a polypeptide including a thioesterase of EC 3.1.2.- or EC 3.1.1.5 or 3.1.2.14; and a CYP153A-reductase hybrid fusion polypeptide variant, wherein the CYP153A-reductase hybrid fusion polypeptide variant has at least 90%, 91%, 93%, 94%, 95%, 96%, 97%, 98%, 99% or 100% sequence identity to any one of SEQ ID NO: 48, SEQ ID NO: 50, SEQ ID NO: 52, SEQ ID NO: 54, SEQ ID NO: 56 SEQ ID NO: 58, SEQ ID NO: 60 SEQ ID NO: 62, SEQ ID NO: 64, SEQ ID NO: 66, SEQ ID NO: 68, SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, and SEQ ID NO: 164. In one embodiment, the CYP153A-reductase hybrid fusion polypeptide variant is a self-sufficient CYP153A-RedRhF hybrid fusion protein variant.

Another aspect of the present disclosure provides a cell culture including the recombinant host cell as discussed above (supra), wherein the cell culture produces an ω-OH fatty acid or composition thereof. In one embodiment, the cell culture produces an ω-OH fatty acid including one or more of a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. In one embodiment, the cell culture produces an unsaturated ω-OH $C_{16:1}$ fatty acid or composition thereof. In another embodiment, the cell culture produces a saturated ω-OH $C_{16}$ fatty acid or composition thereof. In one embodiment, the cell culture produces an unsaturated ω-OH $C_{12:1}$ fatty acid or composition thereof. In another embodiment, the cell culture produces a saturated ω-OH $C_{12}$ fatty acid or composition thereof. In one embodiment, the cell culture produces an unsaturated ω-OH $C_{14:1}$ fatty acid or composition thereof. In another embodiment, the cell culture produces a saturated ω-OH $C_{14}$ fatty acid or composition thereof. In one embodiment, the cell culture produces an unsaturated ω-OH $C_{18:1}$ fatty acid or composition thereof. In another embodiment, the cell culture produces a saturated ω-OH $C_{18}$ fatty acid or composition thereof. In one embodiment, the cell culture produces an unsaturated ω-OH $C_{10:1}$ fatty acid or composition thereof. In another embodiment, the cell culture produces a saturated ω-OH $C_{10}$ fatty acid or composition thereof. In one embodiment, the cell culture produces an unsaturated ω-OH $C_{8:1}$ fatty acid or composition thereof. In another embodiment, the cell culture produces a saturated ω-OH $C_8$ fatty acid or composition thereof. In one embodiment, the cell culture produces an unsaturated ω-OH $C_{20:1}$ fatty acid or composition thereof. In another embodiment, the cell culture produces a saturated ω-OH $C_{20}$ fatty acid or composition thereof. In yet another embodiment, additional saturated or unsaturated ω-OH fatty acids or compositions thereof are produced by the recombinant host cell.

Still another aspect of the present disclosure provides a method of producing an ω-OH fatty acid having an increase in titer, including culturing the host cell (supra) with a carbon source; and harvesting an ω-OH fatty acid or composition thereof. In particular, the method encompasses producing a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative or composition thereof. In one embodiment, the harvested ω-OH fatty acid is an unsaturated ω-OH $C_{16:1}$ fatty acid or composition thereof. In another embodiment, the harvested ω-OH fatty acid is a saturated ω-OH $C_{16}$ fatty acid or composition thereof. In one embodiment, the harvested ω-OH fatty acid is an unsaturated ω-OH $C_{2:1}$ fatty acid or composition thereof. In another embodiment, the harvested ω-OH fatty acid is a saturated ω-OH $C_{12}$ fatty acid or composition thereof. In one embodiment, the harvested ω-OH fatty acid is an unsaturated ω-OH $C_{14:1}$ fatty acid or composition thereof. In another embodiment, the harvested ω-OH fatty acid is a saturated ω-OH $C_{14}$ fatty acid or composition thereof. In one embodiment, the harvested ω-OH fatty acid is an unsaturated ω-OH $C_{18:1}$ fatty acid or composition thereof. In another embodiment, the harvested ω-OH fatty acid is saturated ω-OH $C_{18}$ fatty acid or composition thereof. In one embodiment, the harvested ω-OH fatty acid is an unsaturated ω-OH $C_{10:1}$ fatty acid or composition thereof. In another embodiment, the harvested ω-OH fatty acid is a saturated ω-OH $C_{10}$ fatty acid or composition thereof. In one embodiment, the harvested ω-OH fatty acid is an unsaturated ω-OH $C_{8:1}$ fatty acid or composition thereof. In another embodiment, the harvested ω-OH fatty acid is a saturated ω-OH $C_8$ fatty acid or composition thereof. In one embodiment, the harvested ω-OH fatty acid is an unsaturated ω-OH $C_{20:1}$ fatty acid or composition thereof. In another embodiment, the harvested ω-OH fatty acid is a saturated ω-OH $C_{20}$ fatty acid or composition thereof. In one embodiment, the harvested ω-OH fatty acid is an unsaturated ω-OH $C_{22:1}$ fatty acid or composition thereof. In another embodiment, the harvested ω-OH fatty acid is a saturated ω-OH $C_{22}$ fatty acid or composition thereof.

BRIEF DESCRIPTION OF THE DRAWINGS

The present disclosure is best understood when read in conjunction with the accompanying figures, which serve to illustrate some preferred embodiments. It is understood, however, that the disclosure is not limited to the specific embodiments disclosed in the figures.

FIG. 3 shows the polypeptide sequence of the hybrid cytochrome P450 Cyp153A(G307A)-RedRhF fusion protein (SEQ ID NO: 6) which was used as a template sequence for the variants shown in Sequence Table A.

FIG. 4 shows the polypeptide sequence of the hybrid cytochrome P450 Cyp153A(G307A)-Red450RhF(A796V) fusion protein (SEQ ID NO: 38) which was used as a template sequence for the variants shown in Sequence Table B.

DETAILED DESCRIPTION

General Overview

Figure 1:
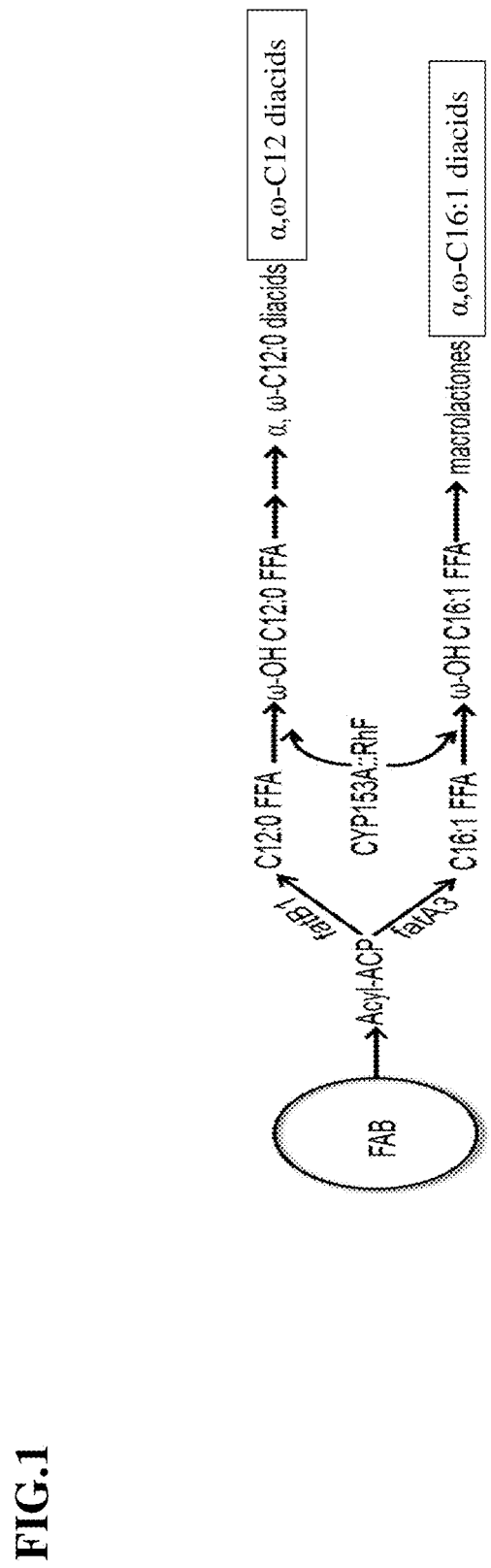
FIG. 1 is a schematic overview of an exemplary biosynthetic pathway for the production of ω-hydroxylated fatty acid derivatives such as, for example, ω-hydroxylated $C_{12}$ fatty acids (ω-OH $C_{12}$ FFA) and/or ω-hydroxylated $C_{16:1}$ fatty acids (ω-OH $C_{16:1}$ FFA) as a result of expressing the CYP153A-reductase hybrid fusion polypeptide variant and a thioesterase polypeptide in a recombinant microorganism. FAB refers to fatty acid biosynthesis in the microorganism; fatB1 refers to a medium-chain acyl-ACP thioesterase from *Umbellularia californica* (California bay); and fatA3 refers to a long-chain acyl-ACP thioesterase from *Arabidopsis thaliana*.

One way of eliminating our dependency on petrochemicals is to produce fatty acid derivatives such as ω-OH fatty acid derivatives through environmentally friendly microorganisms that serve as miniature production hosts. Such cellular hosts (i.e., recombinant host cells or microorganisms) are engineered to produce ω-OH fatty acid derivatives and bi-functional fatty acid derivatives from renewable sources such as renewable feedstock (e.g., fermentable carbohydrates, biomass, cellulose, glycerol, CO, $CO_2$, etc.). These ω-OH fatty acid derivatives are the raw materials for industrial products including specialty chemical, polymers and fragrances.

The present disclosure relates to ω-hydroxylase-related fusion polypeptides including CYP153A-reductase hybrid fusion polypeptides and variants thereof that result in a high titer, yield and/or productivity of ω-OH fatty acid derivative compositions when expressed in recombinant host cells. Herein, enhanced ω-OH fatty acid derivative biosynthesis is accomplished by transforming host cells such that they express a CYP153A-reductase hybrid fusion polypeptide or variant thereof, which catalyzes the reaction of a fatty acid to an ω-OH fatty acid such as, for example, an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid or fatty acid derivative. The disclosure encompasses the recombinant host cells or production strains that express the CYP153A-reductase hybrid fusion polypeptides and variants thereof. In one aspect, the disclosure relates to the P450 subfamily cyp153A.

Definitions

As used in this specification and the appended claims, the singular forms "a," "an" and "the" include plural referents unless the context clearly dictates otherwise. Thus, for example, reference to "a host cell" includes two or more such host cells, reference to "a fatty ester" includes one or more fatty esters, or mixtures of esters, reference to "a nucleic acid sequence" includes one or more nucleic acid sequences, reference to "an enzyme" includes one or more enzymes, and the like.

The term "enzyme classification (EC) number" refers to a number that denotes a specific enzymatic activity. EC numbers classify enzymes according to the reaction they catalyze under a system of enzyme nomenclature. EC numbers specify enzyme-catalyzed reactions. For example, if different enzymes from different organisms catalyze the same reaction, then they have the same EC number. In addition, different protein folds can catalyze an identical reaction and therefore would be assigned an identical EC number (e.g., non-homologous isofunctional enzymes, or NISE). EC numbers are established by the nomenclature committee of the international union of biochemistry and molecular biology (IUBMB), a description of which is available on the IUBMB enzyme nomenclature website on the world wide web. For example, the cytochrome P450 monooxygenase (P450) enzymatic activity, including the ω-hydroxylase or ω-oxygenase enzymatic activity is classified under EC 1.14.15.3. The functionality of enzymes that fall under the P450 enzyme family is conserved in most prokaryotes from one species to the next. Thus, different microbial species can carry out the same enzymatic activity that is classified under EC 1.14.15.3. An example of an enzymatic activity that is characterized by EC 1.14.15.3 is the enzymatic activity of a CYP153A-reductase hybrid fusion polypeptide or variant thereof as discussed herein (supra).

The terms "omega-hydroxylated fatty acid" or "ω-hydroxylated fatty acid" or "ω-hydroxy fatty acid" or "ω-hydroxyl fatty acid" or "ω-OH fatty acid" or "ωOH fatty acid" are used interchangeably herein and refer to a fatty acid that originates from fatty acid metabolism and has at least one OH group at the omega (ω) position. Examples of such ω-hydroxylated fatty acids are $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids. In one embodiment, such ω-hydroxylated fatty acids are ω-OH $C_{8:0}$ fatty acids, ω-OH $C_{10:0}$ fatty acids, ω-OH $C_{12:0}$ fatty acids, ω-OH $C_{14:0}$ fatty acids, ω-OH $C_{16:0}$ fatty acids, ω-OH $C_{18:0}$ fatty acids, ω-OH $C_{20:0}$ fatty acids, ω-OH $C_{8:1}$ fatty acids, ω-OH $C_{10:1}$ fatty acids, ω-OH $C_{12:1}$ fatty acids, ω-OH $C_{14:1}$ fatty acids, ω-OH $C_{16:1}$ fatty acids, ω-OH $C_{18:1}$ fatty acids, ω-OH $C_{20:1}$ fatty acids, and the like. In a microorganism, the ω-hydroxylated fatty acid can be used to produce ω-hydroxylated fatty acid derivatives such as ω-hydroxylated fatty esters as well as bi-functional fatty acid derivatives including α,ω-diacids, α,ω-diesters, and α,ω-diols. In that sense, the terms "omega-hydroxylated fatty acid derivative" and "ω-hydroxylated fatty acid derivative" and "ω-hydroxy fatty acid derivative" and "ω-hydroxyl fatty acid derivative" and "α,ω-bifunctional fatty acid derivative" and "ω-OH fatty acid derivative" refer to a chemical entity that originated from fatty acid metabolism and that has at least one OH group at the omega position or is derived from an intermediate that has at least one OH group at the omega position. Herein, the "omega (ω) position" refers to the terminal carbon atom of a fatty acid derivative at the opposite end in regard to its primary functional group. Such ω-hydroxylated fatty acid derivatives include, but are not limited to, α,ω-diacids; α,ω-diesters; α,ω-diols and chemicals derived thereof (e.g., macrolactones).

An "ω-hydroxylated fatty acid composition" or "ω-OH fatty acid composition" as referred to herein is produced by a recombinant host cell and typically includes a mixture of certain types of ω-hydroxylated fatty acids with various chain lengths and/or saturation and/or branching characteristics. Similarly, an "ω-hydroxylated fatty acid derivative composition" is produced by a recombinant host cell and typically comprises a mixture of certain types of ω-hydroxylated fatty acid derivatives with various chain lengths and/or saturation and/or branching characteristics (e.g., ω-hydroxylated fatty acids with various chain lengths and/or saturation and/or branching characteristics; ω-hydroxylated fatty esters with various chain lengths and/or saturation and/or branching characteristics; α,ω-diacids of various chain length and/or saturation and/or branching characteristics; α,ω-diesters of various chain length and/or saturation and/or branching characteristics; α,ω-diols of various chain length and/or saturation and/or branching characteristics; and the like). In some cases, the ω-OH fatty acid derivative composition includes mostly one type of ω-OH fatty acid derivative such as, for example, 1,12-dodecenediol, or 1,14-tetradecanediol, or 16-hydroxy hexadecanoic acid methyl ester, or 16-hydroxy hexadecenoic acid, or 15-hydroxy pentadecanoic acid, or 15-hydroxy pentadecenoic acid, or 18-hydroxy octacecenoic acid, or the methyl esters of any of these fatty acid derivatives, or others. In still other cases, the ω-OH fatty acid derivative composition comprises a mixture of more than one type of ω-OH fatty acid derivative in order to provide a specifically designed composition (e.g., about 20% 12-hydroxy dodecanoic acid and about 80% 1,14-14-hydroxy tetradecanoic acid in the same composition would provide such an example).

The term "accession number" or "NCBI accession number" or "GenBank accession number" refers to a number that denotes a specific nucleic acid sequence. Sequence accession numbers that are discussed in this description were obtained from databases provided by the NCBI (National Center for Biotechnology Information) maintained by the National Institutes of Health, U.S.A., and from the UniProt Knowledgebase (UniProtKB) and Swiss-Prot databases provided by the Swiss Institute of Bioinformatics (also referred to as UniProtKB accession number).

As used herein, the term "nucleotide" refers to a monomeric unit of a polynucleotide that consists of a heterocyclic base, a sugar, and one or more phosphate groups. The naturally occurring bases (guanine, (G), adenine, (A), cytosine, (C), thymine, (T), and uracil (U)) are typically derivatives of purine or pyrimidine, though it should be understood that naturally and non-naturally occurring base analogs are also included. The naturally occurring sugar is the pentose (five-carbon sugar) deoxyribose (which forms DNA) or ribose (which forms RNA), though it should be understood that naturally and non-naturally occurring sugar analogs are also included. Nucleic acids are typically linked via phosphate bonds to form nucleic acids or polynucleotides, though many other linkages are known in the art (e.g., phosphorothioates, boranophosphates, and the like).

The term "polynucleotide" refers to a polymer of ribonucleotides (RNA) or deoxyribonucleotides (DNA), which can be single-stranded or double-stranded and which can contain non-natural or altered nucleotides. The terms "polynucleotide," "nucleic acid sequence," and "nucleotide sequence" are used interchangeably herein to refer to a polymeric form of nucleotides of any length, either RNA or DNA. These terms refer to the primary structure of the molecule, and thus include double- and single-stranded DNA, and double- and single-stranded RNA. The terms include, as equivalents, analogs of either RNA or DNA made from nucleotide analogs and modified polynucleotides such as, though not limited to methylated and/or capped polynucleotides. The polynucleotide can be in any form, including but not limited to, plasmid, viral, chromosomal, EST, cDNA, mRNA, and rRNA.

As used herein, the terms "polypeptide" and "protein" are used interchangeably to refer to a polymer of amino acid residues. The term "recombinant polypeptide" refers to a polypeptide that is produced by recombinant techniques, wherein generally DNA or RNA encoding the expressed protein is inserted into a suitable expression vector that is in turn used to transform a host cell to produce the polypeptide. Similarly, the terms "recombinant polynucleotide" or "recombinant nucleic acid" or "recombinant DNA" are produced by recombinant techniques that are known to those of skill in the art.

The terms "homolog," and "homologous" refer to a polynucleotide or a polypeptide comprising a sequence that is at least about 50 percent (%) identical to the corresponding polynucleotide or polypeptide sequence. Preferably homologous polynucleotides or polypeptides have polynucleotide sequences or amino acid sequences that have at least about 80%, 81%, 82%, 83%, 84%, 85%, 86%, 87%, 88%, 89%, 90%, 91%, 92%, 93%, 94%, 95%, 96%, 97%, 98% or at least about 99% homology to the corresponding amino acid sequence or polynucleotide sequence. As used herein the terms sequence "homology" and sequence "identity" are used interchangeably. One of ordinary skill in the art is well aware of methods to determine homology between two or more sequences. Briefly, calculations of "homology" between two sequences can be performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). In one preferred embodiment, the length of a first sequence that is aligned for comparison purposes is at least about 30%, preferably at least about 40%, more preferably at least about 50%, even more preferably at least about 60%, and even more preferably at least about 70%, at least about 80%, at least about 85%, at least about 90%, at least about 95%, at least about 98%, or about 100% of the length of a second sequence. The amino acid residues or nucleotides at corresponding amino acid positions or nucleotide positions of the first and second sequences are then compared. When a position in the first sequence is occupied by the same amino acid residue or nucleotide as the corresponding position in the second sequence, then the molecules are identical at that position. The percent homology between the two sequences is a function of the number of identical positions shared by the sequences, taking into account the number of gaps and the length of each gap, that need to be introduced for optimal alignment of the two sequences. The comparison of sequences and determination of percent homology between two sequences can be accomplished using a mathematical algorithm, such as BLAST (Altschul et al. (1990) *J. Mol. Biol.* 215(3):403-410). The percent homology between two amino acid sequences also can be determined using the Needleman and Wunsch algorithm that has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6 (Needleman and Wunsch (1970) *J. Mol. Biol.* 48:444-453). The percent homology between two nucleotide sequences also can be determined using the GAP program in the GCG software package, using a NWSgapdna.CMP matrix and a gap weight of 40, 50, 60, 70, or 80 and a length weight of 1, 2, 3, 4, 5, or 6. One of ordinary skill in the art can perform initial homology calculations and adjust the algorithm parameters accordingly. A preferred set of parameters (and the one that should be used if a practitioner is uncertain about which parameters should be applied to determine if a molecule is within a homology limitation of the claims) are a Blossum 62 scoring matrix with a gap penalty of 12, a gap extend penalty of 4, and a frameshift gap penalty of 5. Additional methods of sequence alignment are known in the biotechnology arts (see, e.g., Rosenberg (2005) *BMC Bioinformatics* 6:278; Altschul et al. (2005) *FEBS J.* 272(20):5101-5109).

The term "hybridizes under low stringency, medium stringency, high stringency, or very high stringency conditions" describes conditions for hybridization and washing. Guidance for performing hybridization reactions can be found in Current Protocols in Molecular Biology, John Wiley & Sons, N.Y. (1989), 6.3.1-6.3.6. Aqueous and non-aqueous methods are described in that reference and either method can be used. Specific hybridization conditions referred to herein are as follows: (1) low stringency hybridization conditions—6× sodium chloride/sodium citrate (SSC) at about 45° C., followed by two washes in 0.2×SSC, 0.1% SDS at least at 50° C. (the temperature of the washes can be increased to 55° C. for low stringency conditions); (2) medium stringency hybridization conditions—6×SSC at about 45° C., followed by one or more washes in 0.2×SSC, 0.1% SDS at 60° C.; (3) high stringency hybridization conditions—6× SSC at about 45° C., followed by one or more washes in 0.2× SSC, 0.1% SDS at 65° C.; and (4) very high stringency hybridization conditions—0.5M sodium phosphate, 7% SDS at 65° C., followed by one or more washes at 0.2×SSC, 1% SDS at 65° C. Very high stringency conditions (4) are the preferred conditions unless otherwise specified.

An "endogenous" polypeptide refers to a polypeptide encoded by the genome of the parental cell (or host cell) or that originates or develops or comes from within that parental host cell. An "exogenous" polypeptide refers to a polypeptide which is not encoded by the genome of the parental cell or that originates outside that parental host cell. A variant or mutant polypeptide is an example of an exogenous polypeptide. Thus, a non-naturally-occurring nucleic acid molecule is considered to be exogenous to a cell once introduced into the cell. A nucleic acid molecule that is naturally-occurring can also be exogenous to a particular cell. For example, an entire coding sequence isolated from cell X is an exogenous nucleic acid with respect to cell Y once that coding sequence is introduced into cell Y, even if X and Y are the same cell type.

The term "overexpressed" means that a gene is caused to be transcribed at an elevated rate compared to the wildtype or native or endogenous transcription rate for that gene. In some examples, overexpression additionally includes an elevated rate of translation of the gene compared to the wildtype or native or endogenous translation rate for that gene. Methods of testing for overexpression are well known in the art, for example transcribed RNA levels can be assessed using rtPCR and protein levels can be assessed using SDS page gel analysis.

The term "heterologous" means derived from a different organism, different cell type, or different species. As used herein it refers to a nucleotide-, polynucleotide-, polypeptide- or protein sequence, not naturally present in a given organism. For example, a polynucleotide sequence that is native to cyanobacteria can be introduced into a host cell of *E. coli* by recombinant methods, and the polynucleotide from cyanobacteria is then heterologous to the *E. coli* cell (e.g., recombinant cell). The term "heterologous" may also be used with reference to a nucleotide-, polynucleotide-, polypeptide-, or protein sequence which is present in a recombinant host cell in a non-native state. For example, a "heterologous" nucleotide, polynucleotide, polypeptide or protein sequence may be modified relative to the wild type sequence naturally present in the corresponding wild type host cell, e.g., a modification in the level of expression or in the sequence of a nucleotide, polynucleotide, polypeptide or protein.

As used herein, the term "fragment" of a polypeptide refers to a shorter portion of a full-length polypeptide or protein ranging in size from two amino acid residues to the entire amino acid sequence minus one amino acid residue. In certain embodiments of the disclosure, a fragment refers to the entire amino acid sequence of a domain of a polypeptide or protein (e.g., a substrate binding domain or a catalytic domain).

The term "mutagenesis" refers to a process by which the genetic information of an organism is changed in a stable manner. Mutagenesis of a protein coding nucleic acid sequence produces a mutant protein. Mutagenesis also refers to changes in non-coding nucleic acid sequences that result in modified protein activity.

A "mutation", as used herein, refers to a permanent change in a nucleic acid position of a gene or permanent change in an amino acid position of a polypeptide or protein. Mutations include substitutions, additions, insertions, and deletions. For example, a mutation in an amino acid position can be a substitution of one type of amino acid with another type of amino acid (e.g., a serine (S) may be substituted with an alanine (A); a lysine (L) may be substituted with a threonine (T); etc.). As such, a polypeptide or a protein can have one or more mutations wherein one amino acid is substituted with another amino acid. The CYP153A-reductase hybrid fusion polypeptide variants provided by the present disclosure have mutations at specific amino acid positions in the amino acid sequence of SEQ ID NO: 38. For example, provided by the present disclosure is a CYP153A-reductase hybrid fusion polypeptide variant, which has a mutation at each of amino acid positions 12, 27, 119, 140, 157, 159, 233, and 244 of SEQ ID NO: 38. The CYP153A-reductase hybrid fusion polypeptide variant having a mutation at each of these specific amino acid positions catalyzes the conversion of a fatty acid to an omega-hydroxylated fatty acid. Preferably, the CYP153A-reductase hybrid fusion polypeptide variant having a mutation at each of these specific amino acid positions can produce ω-OH fatty acid derivatives at a higher titer when compared to the CYP153A-reductase hybrid fusion polypeptide of, e.g., SEQ ID NO: 38. Therefore, mutations at the specific amino acid positions of the claimed CYP153A-reductase hybrid fusion polypeptide variants preferably do not include mutations, which may not provide for the claimed effect of producing ω-OH fatty acid derivatives at a higher titer when compared to the CYP153A-reductase hybrid fusion polypeptide of, e.g., SEQ ID NO: 38. A CYP153A-reductase hybrid fusion polypeptide variant of the present disclosure can be screened for its function, such as, an improved function compared to a wild type CYP153A polypeptide, or a template CYP153A-reductase hybrid fusion polypeptide, or any other reference CYP153A-reductase hybrid fusion polypeptide, including but not limited to increased catalytic activity, increased stability, or decreased inhibition (e.g., decreased feedback inhibition), using methods known in the art. In various embodiments of the present disclosure, the mutations at the specific positions defined in the claims are of such nature that they provide for an increased amount of ω-hydroxy fatty acids (ω-OH FFA titer), and/or an increased conversion of fatty acids to ω-hydroxy fatty acids, as compared to the CYP153A-reductase hybrid fusion polypeptide of, e.g., SEQ ID NO: 38. In various embodiments, the mutations at the specific positions defined in the claims are of such nature that they provide for an increased amount of ω-hydroxy fatty acids (ω-OH FFA titer), and/or an increased conversion of fatty acids to ω-hydroxy fatty acids, as compared to the CYP153A-reductase hybrid fusion polypeptide of, e.g., SEQ ID NO: 42 or SEQ ID NO: 46. In various embodiments, the mutations at the specific positions defined in the claims are of such nature that they provide for an increased amount of ω-hydroxy fatty acids (ω-OH FFA titer), and/or an increased conversion of fatty acids to ω-hydroxy fatty acids, as compared to the CYP153A-reductase hybrid fusion polypeptide of, e.g., SEQ ID NO: 98. In various embodiments of the present disclosure, one or more of the mutations at the specific positions defined in the claims mean one or more amino acid substitutions and/or deletions. Preferably, one or more of the mutations at the specific positions defined in the claims mean one or more amino acid substitutions. More preferably, all of the mutations at the specific positions defined in the claims for a given CYP153A-reductase hybrid fusion polypeptide variant are amino acid substitutions. If an amino acid residue at a certain position is deleted, and a different amino acid residue is inserted at that position, this can be considered as substitution of an amino acid residue at a certain position. In various embodiments of the present disclosure, a mutation at an amino acid position means an amino acid substitution (at that position), wherein the substitution is not a silent substitution.

As used herein, the term "gene" refers to nucleic acid sequences encoding either an RNA product or a protein product, as well as operably-linked nucleic acid sequences affecting the expression of the RNA or protein (e.g., such sequences include but are not limited to promoter or enhancer sequences) or operably-linked nucleic acid sequences encoding sequences that affect the expression of the RNA or protein (e.g., such sequences include but are not limited to ribosome binding sites or translational control sequences).

Expression control sequences are known in the art and include, for example, promoters, enhancers, polyadenylation signals, transcription terminators, internal ribosome entry sites (IRES), and the like, that provide for the expression of the polynucleotide sequence in a host cell. Expression control sequences interact specifically with cellular proteins involved in transcription (Maniatis et al. (1987) *Science* 236:1237-1245). Exemplary expression control sequences are described in, for example, Goeddel, Gene Expression Technology: Methods in Enzymology, Vol. 185, Academic Press, San Diego, Calif. (1990). In the methods of the disclosure, an expression control sequence is operably linked to a polynucleotide sequence. By "operably linked" is meant that a polynucleotide sequence and an expression control sequence are connected in such a way as to permit gene expression when the appropriate molecules (e.g., transcriptional activator proteins) are bound to the expression control sequence. Operably linked promoters are located upstream of the selected polynucleotide sequence in terms of the direction of transcription and translation. Operably linked enhancers can be located upstream, within, or downstream of the selected polynucleotide.

As used herein, the term "vector" refers to a nucleic acid molecule capable of transporting another nucleic acid, i.e., a polynucleotide sequence, to which it has been linked. One type of useful vector is an episome (i.e., a nucleic acid capable of extra-chromosomal replication). Useful vectors are those capable of autonomous replication and/or expression of nucleic acids to which they are linked. Vectors capable of directing the expression of genes to which they are operatively linked are referred to herein as "expression vectors." In general, expression vectors of utility in recombinant DNA techniques are often in the form of "plasmids," which refer generally to circular double stranded DNA loops that, in their vector form, are not bound to the chromosome. Other useful expression vectors are provided in linear form. Also included are such other forms of expression vectors that serve equivalent functions and that have become known in the art subsequently hereto. In some embodiments, a recombinant vector further includes a promoter operably linked to the polynucleotide sequence. In some embodiments, the promoter is a developmentally-regulated promoter, an organelle-specific promoter, a tissue-specific promoter, an inducible promoter, a constitutive promoter, or a cell-specific promoter. The recombinant vector typically comprises at least one sequence selected from an expression control sequence operatively coupled to the polynucleotide sequence; a selection marker operatively coupled to the polynucleotide sequence; a marker sequence operatively coupled to the polynucleotide sequence; a purification moiety operatively coupled to the polynucleotide sequence; a secretion sequence operatively coupled to the polynucleotide sequence; and a targeting sequence operatively coupled to the polynucleotide sequence. In certain embodiments, the nucleotide sequence is stably incorporated into the genomic DNA of the host cell, and the expression of the nucleotide sequence is under the control of a regulated promoter region. The expression vectors as used herein include a particular polynucleotide sequence as described herein in a form suitable for expression of the polynucleotide sequence in a host cell. It will be appreciated by those skilled in the art that the design of the expression vector can depend on such factors as the choice of the host cell to be transformed, the level of expression of polypeptide desired, etc. The expression vectors described herein can be introduced into host cells to produce polypeptides, including fusion polypeptides, encoded by the polynucleotide sequences as described herein. Expression of genes encoding polypeptides in prokaryotes, for example, E. coli, is most often carried out with vectors containing constitutive or inducible promoters directing the expression of either fusion or non-fusion polypeptides. Fusion vectors add a number of amino acids to a polypeptide encoded therein, usually to the amino- or carboxy-terminus of the recombinant polypeptide. Such fusion vectors typically serve one or more of the following three purposes, including increasing expression of the recombinant polypeptide; to increase the solubility of the recombinant polypeptide; and to aid in the purification of the recombinant polypeptide by acting as a ligand in affinity purification. Often, in fusion expression vectors, a proteolytic cleavage site is introduced at the junction of the fusion moiety and the recombinant polypeptide. This enables separation of the recombinant polypeptide from the fusion moiety after purification of the fusion polypeptide. In certain embodiments, a polynucleotide sequence of the disclosure is operably linked to a promoter derived from bacteriophage T5.

In certain embodiments, the host cell is a yeast cell, and the expression vector is a yeast expression vector. Examples of vectors for expression in yeast S. cerevisiae include pYepSec1 (Baldari et al. (1987) EMBO J. 6:229-234); pMFa (Kurjan et al. (1982) Cell 30:933-943); pJRY88 (Schultz et al. (1987) Gene 54: 113-123); pYES2 (Invitrogen Corp., San Diego, Calif.), and picZ (Invitrogen Corp., San Diego, Calif.). In other embodiments, the host cell is an insect cell, and the expression vector is a baculovirus expression vector. Baculovirus vectors available for expression of proteins in cultured insect cells (e.g., Sf9 cells) include, for example, the pAc series (Smith et al. (1983) Mol. Cell Biol. 3:2156-2165) and the pVL series (Lucklow et al. (1989) Virology 170:31-39). In yet another embodiment, the polynucleotide sequences described herein can be expressed in mammalian cells using a mammalian expression vector. Other suitable expression systems for both prokaryotic and eukaryotic cells are well known in the art; see, e.g., Sambrook et al., "Molecular Cloning: A Laboratory Manual," second edition, Cold Spring Harbor Laboratory, (1989).

As used herein, the term "CoA" or "acyl-CoA" refers to an acyl thioester formed between the carbonyl carbon of alkyl chain and the sulfhydryl group of the 4'-phosphopantethionyl moiety of coenzyme A (CoA), which has the formula R—C(O)S-CoA, where R is any alkyl group having at least 4 carbon atoms.

The term "ACP" means acyl carrier protein. ACP is a highly conserved carrier of acyl intermediates during fatty acid biosynthesis, wherein the growing chain is bound during synthesis as a thiol ester at the distal thiol of a 4'-phosphopantetheine moiety. The protein exists in two forms, i.e., apo-ACP (inactive in fatty acid biosynthesis) and ACP or holo-ACP (active in fatty acid biosynthesis). The terms "ACP" and "holo-ACP" are used interchangeably herein and refer to the active form of the protein. An enzyme called a phosphopantetheinyltransferase is involved in the conversion of the inactive apo-ACP to the active holo-ACP. More specifically, ACP is expressed in the inactive apo-ACP form and a 4'-phosphopantetheine moiety must be post-translationally attached to a conserved serine residue on the ACP by the action of holo-acyl carrier protein synthase (ACPS), a phosphopantetheinyltransferase, in order to produce holo-ACP.

As used herein, the term "acyl-ACP" refers to an acyl thioester formed between the carbonyl carbon of an alkyl chain and the sulfhydryl group of the phosphopantetheinyl moiety of an acyl carrier protein (ACP). In some embodiments an ACP is an intermediate in the synthesis of fully saturated acyl-ACPs. In other embodiments an ACP is an intermediate in the synthesis of unsaturated acyl-ACPs. In some embodiments, the carbon chain will have about 5, 6, 7, 8, 9, 10, 11, 12, 13, 14, 15, 16, 17, 18, 19, 20, 21, 22, 23, 24, 25, or 26 carbons.

As used herein, the term "fatty acid derivative" means a "fatty acid" or a "fatty acid derivative", which may be referred to as a "fatty acid or derivative thereof". The term "fatty acid" means a carboxylic acid having the formula RCOOH. R represents an aliphatic group, preferably an alkyl group. R can include between about 4 and about 22 carbon atoms. Fatty acids can be saturated, monounsaturated, or polyunsaturated. A "fatty acid derivative" is a product made in part from the fatty acid biosynthetic pathway of the production host organism (e.g., recombinant host cell or microorganism). "Fatty acid derivatives" includes products made in part from ACP, acyl-ACP or acyl-ACP derivatives. Exemplary fatty acid derivatives include, for example, acyl-CoA, fatty acids, fatty aldehydes, short and long chain alcohols, fatty alcohols, hydrocarbons, esters (e.g., waxes, fatty acid esters, or fatty esters), terminal olefins, internal olefins, ketones as well as ω-OH fatty acids and ω-OH fatty acid derivatives thereof including α,ω-diacids, and other bifunctional compounds.

As used herein, the term "fatty acid biosynthetic pathway" means a biosynthetic pathway that produces fatty acids and derivatives thereof. The fatty acid biosynthetic pathway may include additional enzymes to produce fatty acids derivatives having desired characteristics.

The R group of a fatty acid can be a straight chain or a branched chain. Branched chains may have more than one point of branching and may include cyclic branches. In some embodiments, the branched fatty acid is a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{21}$, $C_{22}$, $C_{23}$, $C_{24}$, $C_{25}$, or a $C_{26}$ branched fatty acid. In other embodiments, the branched fatty acid is a $C_6$, $C_8$, $C_{10}$, $C_{12}$, $C_{13}$, $C_{14}$, $C_{15}$, $C_{16}$, $C_{17}$, $C_{18}$, or $C_{20}$ branched fatty acid. In certain embodiments, the hydroxyl (OH) group of the branched fatty acid is in the omega (ω) position. In certain embodiments, the branched fatty acid is an iso-fatty acid or an anteiso-fatty acid. In exemplary embodiments, the branched fatty acid is selected from iso-$C_{7:0}$-, iso-$C_{8:0}$-, iso-$C_{9:0}$-, iso-$C_{10:0}$-, iso-$C_{11:0}$-, iso-$C_{12:0}$-, iso-$C_{13:0}$-, iso-$C_{14:0}$-, iso-$C_{15:0}$-, iso-$C_{16:0}$-, iso-$C_{17:0}$-, iso-$C_{18:0}$-, iso-$C_{19:0}$-, iso-$C_{20:0}$, anteiso-$C_{7:0}$-, anteiso-$C_{9:0}$-, anteiso-$C_{11:0}$-, anteiso-$C_{13:0}$-, anteiso-$C_{15:0}$-, anteiso-$C_{17:0}$-, and anteiso-$C_{19:0}$ branched fatty acid.

The R group of a fatty acid can be saturated or unsaturated. If unsaturated, the R group can have one or more than one point of unsaturation. In some embodiments, the unsaturated fatty acid is a monounsaturated fatty acid. In certain embodiments, the unsaturated fatty acid is a $C_{8:1}$-, $C_{9:1}$-, $C_{10:1}$-, $C_{11:1}$-, $C_{12:1}$-, $C_{13:1}$-, $C_{14:1}$-, $C_{15:1}$-, $C_{16:1}$-, $C_{17:1}$-, $C_{18:1}$-, $C_{19:1}$-, $C_{20:1}$-, $C_{21:1}$-, $C_{22:1}$-, $C_{23:1}$-, $C_{24:1}$-, $C_{25:1}$-, or a $C_{26:1}$ unsaturated fatty acid. In certain embodiments, the unsaturated fatty acid is $C_{8:1}$, $C_{10:1}$, $C_{12:1}$, $C_{14:1}$, $C_{16:1}$, $C_{18:1}$, or $C_{20:1}$. In yet other embodiments, the unsaturated fatty acid is unsaturated at the omega-7 position. In certain embodiments, the unsaturated fatty acid has a cis double bond.

As used herein, a "recombinant host cell" or "engineered host cell" is a host cell, e.g., a microorganism that has been modified such that it produces ω-hydroxylated fatty acids and ω-hydroxylated fatty acid derivatives including bifunctional fatty acid derivatives. In some embodiments, the recombinant host cell includes one or more polynucleotides, each polynucleotide encoding a CYP153A-reductase hybrid fusion polypeptide or variant thereof that has ω-hydroxylase biosynthetic enzyme activity, wherein the recombinant host cell produces an ω-hydroxylated fatty acid and/or ω-hydroxylated fatty acid derivative or composition thereof when cultured in the presence of a carbon source under conditions effective to express the polynucleotides.

As used herein, the term "clone" typically refers to a cell or group of cells descended from and essentially genetically identical to a single common ancestor, for example, the bacteria of a cloned bacterial colony arose from a single bacterial cell.

As used herein, the term "culture" typically refers to a liquid media comprising viable cells. In one embodiment, a culture comprises cells reproducing in a predetermined culture media under controlled conditions, for example, a culture of recombinant host cells grown in liquid media comprising a selected carbon source and/or nitrogen.

The terms "culturing" or "cultivation" refers to growing a population of cells (e.g., microbial cells) under suitable conditions in a liquid or solid medium. In particular embodiments, culturing refers to the fermentative bioconversion of a substrate to an end-product. Culturing media are well known and individual components of such culture media are available from commercial sources, e.g., under the DIFCO media and BBL media. In one non-limiting example, the aqueous nutrient medium is a "rich medium" comprising complex sources of nitrogen, salts, and carbon, such as YP medium, comprising 10 g/L of peptone and 10 g/L yeast extract of such a medium. In addition, the host cell can be engineered to assimilate carbon efficiently and use cellulosic materials as carbon sources according to methods described, for example, in U.S. Pat. Nos. 5,000,000; 5,028,539; 5,424, 202; 5,482,846; 5,602,030 and WO2010127318. In addition, the host cell can be engineered to express an invertase so that sucrose can be used as a carbon source.

As used herein, the term "under conditions effective to express said heterologous nucleotide sequences" means any conditions that allow a host cell to produce a desired fatty acid derivative (e.g., ω-OH fatty acid and/or ω-OH fatty acid derivative). Suitable conditions include, for example, fermentation conditions.

As used herein, "modified" or an "altered level of" activity of a protein, for example an enzyme, in a recombinant host cell refers to a difference in one or more characteristics in the activity determined relative to the parent or native host cell. Typically differences in activity are determined between a recombinant host cell, having modified activity, and the corresponding wild-type host cell (e.g., comparison of a culture of a recombinant host cell relative to wild-type host cell). Modified activities can be the result of, for example, modified amounts of protein expressed by a recombinant host cell (e.g., as the result of increased or decreased number of copies of DNA sequences encoding the protein, increased or decreased number of mRNA transcripts encoding the protein, and/or increased or decreased amounts of protein translation of the protein from mRNA); changes in the structure of the protein (e.g., changes to the primary structure, such as, changes to the protein's coding sequence that result in changes in substrate specificity, changes in observed kinetic parameters); and changes in protein stability (e.g., increased or decreased degradation of the protein). In some embodiments, the polypeptide is a mutant or a variant of any of the polypeptides described herein. In certain instances, the coding sequence for the polypeptides as described herein are codon optimized for expression in a particular host cell. For example, for expression in *E. coli*, one or more codons can be optimized (Grosjean et al. (1982) Gene 18:199-209).

The term "regulatory sequences" as used herein typically refers to a sequence of bases in DNA, operably-linked to DNA sequences encoding a protein that ultimately controls the expression of the protein. Examples of regulatory sequences include, but are not limited to, RNA promoter sequences, transcription factor binding sequences, transcription termination sequences, modulators of transcription (such as enhancer elements), nucleotide sequences that affect RNA stability, and translational regulatory sequences (such as, ribosome binding sites (e.g., Shine-Dalgarno sequences in prokaryotes or Kozak sequences in eukaryotes), initiation codons, termination codons).

As used herein, the phrase "the expression of said nucleotide sequence is modified relative to the wild type nucleotide sequence," means an increase or decrease in the level of expression and/or activity of an endogenous nucleotide sequence or the expression and/or activity of a heterologous or non-native polypeptide-encoding nucleotide sequence.

As used herein, the phrase "the activity of a CYP153A-reductase hybrid fusion polypeptide sequence variant is modified relative to the activity of a CYP153A-reductase hybrid fusion polypeptide sequence" (i.e., a polypeptide template) means an increase or decrease in the level of activity of an expressed polypeptide sequence variant in comparison to an expressed polypeptide sequence template. The polypeptide template is encoded by a nucleic acid template (i.e., a DNA template sequence). An example of a polypeptide sequence template is the hybrid cyp153A-RedRhF fusion protein sequence, wherein a cyp153A is fused with a reductase domain. Another example of a polypeptide sequence template is SEQ ID NO: 6. Another example of a polypeptide sequence template is SEQ ID NO: 38. Any polypeptide sequence can serve as a template including variants.

As used herein, the term "express" with respect to a polynucleotide is to cause it to function. A polynucleotide which encodes a polypeptide (or protein) will, when expressed, be transcribed and translated to produce that polypeptide (or protein). As used herein, the term "overexpress" means to express (or cause to express) a polynucleotide or polypeptide in a cell at a greater concentration than is normally expressed in a corresponding wild-type cell under the same conditions. In another embodiment, the term "overexpress" means to express (or cause to express) a polynucleotide or polypeptide in a cell at a greater concentration than it is normally expressed in a corresponding cell that expresses the template polynucleotide or template polypeptide sequence under the same conditions. An example of a template polypeptide sequence is the CYP153A-RedRhF-hybrid fusion polypeptide.

The terms "altered level of expression" and "modified level of expression" are used interchangeably and mean that a polynucleotide, polypeptide, or fatty acid derivative is present in a different concentration in an engineered host cell as compared to its concentration in a corresponding wild-type cell under the same conditions.

As used herein, the term "titer" refers to the quantity of ω-OH fatty acids and/or ω-OH fatty acid derivatives produced per unit volume of host cell culture. In any aspect of the compositions and methods described herein, an ω-OH fatty acid and/or ω-OH fatty acid derivative is produced at a titer of about 25 mg/L, about 50 mg/L, about 75 mg/L, about 100 mg/L, about 125 mg/L, about 150 mg/L, about 175 mg/L, about 200 mg/L, about 225 mg/L, about 250 mg/L, about 275 mg/L, about 300 mg/L, about 325 mg/L, about 350 mg/L, about 375 mg/L, about 400 mg/L, about 425 mg/L, about 450 mg/L, about 475 mg/L, about 500 mg/L, about 525 mg/L, about 550 mg/L, about 575 mg/L, about 600 mg/L, about 625 mg/L, about 650 mg/L, about 675 mg/L, about 700 mg/L, about 725 mg/L, about 750 mg/L, about 775 mg/L, about 800 mg/L, about 825 mg/L, about 850 mg/L, about 875 mg/L, about 900 mg/L, about 925 mg/L, about 950 mg/L, about 975 mg/L, about 1000 mg/L, about 1050 mg/L, about 1075 mg/L, about 1100 mg/L, about 1125 mg/L, about 1150 mg/L, about 1175 mg/L, about 1200 mg/L, about 1225 mg/L, about 1250 mg/L, about 1275 mg/L, about 1300 mg/L, about 1325 mg/L, about 1350 mg/L, about 1375 mg/L, about 1400 mg/L, about 1425 mg/L, about 1450 mg/L, about 1475 mg/L, about 1500 mg/L, about 1525 mg/L, about 1550 mg/L, about 1575 mg/L, about 1600 mg/L, about 1625 mg/L, about 1650 mg/L, about 1675 mg/L, about 1700 mg/L, about 1725 mg/L, about 1750 mg/L, about 1775 mg/L, about 1800 mg/L, about 1825 mg/L, about 1850 mg/L, about 1875 mg/L, about 1900 mg/L, about 1925 mg/L, about 1950 mg/L, about 1975 mg/L, about 2000 mg/L (2 g/L), 3 g/L, 5 g/L, 10 g/L, 20 g/L, 30 g/L, 40 g/L, 50 g/L, 60 g/L, 70 g/L, 80 g/L, 90 g/L, 100 g/L or a range bounded by any two of the foregoing values. In other embodiments, an ω-OH fatty acid and/or ω-OH fatty acid derivative is produced at a titer of more than 100 g/L, more than 200 g/L, more than 300 g/L, or higher, such as 500 g/L, 700 g/L, 1000 g/L, 1200 g/L, 1500 g/L, or 2000 g/L. In one embodiment, the titer of an ω-OH fatty acid and/or ω-OH fatty acid derivative produced by a recombinant host cell according to the methods of the disclosure is from 5 g/L to 200 g/L, 10 g/L to 150 g/L, 20 g/L to 120 g/L, 25 g/L to 110 g/L and 30 g/L to 100 g/L.

As used herein, the term "yield of the ω-OH fatty acids and/or ω-OH fatty acid derivatives produced by a host cell" refers to the efficiency by which an input carbon source is converted to product (i.e., ω-OH fatty acids and/or ω-OH fatty acid derivatives) in a host cell. Host cells engineered to produce ω-OH fatty acids and/or ω-OH fatty acid derivatives according to the methods of the disclosure have a yield of at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 26%, at least 27%, at least 28%, at least 29%, or at least 30% or a range bounded by any two of the foregoing values. In other embodiments, an ω-OH fatty acid and/or ω-OH fatty acid derivative is produced at a yield of more than 30%, 40%, 50%, 60%, 70%, 80%, 90% or more. Alternatively, or in addition, the yield is about 30% or less, about 27% or less, about 25% or less, or about 22% or less. Thus, the yield can be bounded by any two of the above endpoints. For example, the yield of an ω-OH fatty acid and/or ω-OH fatty acid derivative produced by the recombinant host cell according to the methods of the disclosure can be 5% to 15%, 10% to 25%, 10% to 22%, 15% to 27%, 18% to 22%, 20% to 28%, 20% to 30%, 25% to 40%, or greater. An example of a preferred yield of an ω-OH fatty acid and/or ω-OH fatty acid derivative produced by the recombinant host cell according to the methods of the disclosure is from 10% to 30%. Another example of a preferred yield of an ω-OH fatty acid and/or ω-OH fatty acid derivative produced by the recombinant host cell according to the methods of the disclosure is from 10% to 40%. Another example of a preferred yield of an ω-OH fatty acid and/or ω-OH fatty acid derivative produced by the recombinant host cell according to the methods of the disclosure is from 10% to 50%.

As used herein, the term "productivity" refers to the quantity of ω-OH fatty acids and/or ω-OH fatty acid derivatives produced per unit volume of host cell culture per unit time. In any aspect of the compositions and methods described herein, the productivity of an ω-OH fatty acid and/or ω-OH fatty acid derivative produced by a recombinant host cell is at least 100 mg/L/hour, at least 200 mg/L/hour, at least 300 mg/L/hour, at least 400 mg/L/hour, at least 500 mg/L/hour, at least 600 mg/L/hour, at least 700 mg/L/hour, at least 800 mg/L/hour, at least 900 mg/L/hour, at least 1000 mg/L/hour, at least 1100 mg/L/hour, at least 1200 mg/L/hour, at least 1300 mg/L/hour, at least 1400 mg/L/hour, at least 1500 mg/L/hour, at least 1600 mg/L/hour, at least 1700 mg/L/hour, at least 1800 mg/L/hour, at least 1900 mg/L/hour, at least 2000 mg/L/hour, at least 2100 mg/L/hour, at least 2200 mg/L/hour, at least 2300 mg/L/hour, at least 2400 mg/L/hour, or at least 2500 mg/L/hour. In addition, the productivity may be 2500 mg/L/hour or less, 2000 mg/L/$OD_{600}$ or less, 1500 mg/L/$OD_{600}$ or less, 120 mg/L/hour, or less, 1000 mg/L/hour or less, 800 mg/L/hour, or less, or 600 mg/L/hour or less. Thus, the productivity can be bounded by any two of the above endpoints. For example, the productivity can be 3 to 30 mg/L/hour, 6 to 20 mg/L/hour, or 15 to 30 mg/L/hour. The preferred productivity of an ω-OH fatty acid and/or ω-OH fatty acid derivative produced by a recombinant host cell according to the methods of the disclosure is selected from 500 mg/L/hour to 2500 mg/L/hour, or from 700 mg/L/hour to 2000 mg/L/hour.

The terms "total fatty species (FAS)" and "total fatty acid product" may be used interchangeably herein with reference to the total amount of ω-OH fatty acids and fatty acids present in a sample as evaluated by GC-FID as described in International Patent Application Publication WO 2008/119082.

As used herein, the term "glucose utilization rate" means the amount of glucose used by the culture per unit time, reported as grams/liter/hour (g/L/hr).

The term "carbon source from a renewable feedstock" when used alone or in reference to a feed source includes any biological material (including renewable feedstocks and/or biomass and/or waste products) from which carbon is derived except oleochemicals (i.e., refined oils from plants and animals such as fatty acids, fatty acid esters, TAGs, hydroxy fatty acids, and the like) and petrochemicals (i.e., chemicals derived from petroleum such as alkanes, alkenes, and the like). Thus, the term "carbon source from a renewable feedstock", as used herein, excludes carbon derived from oleochemicals and petrochemicals. In some embodiments, the carbon source includes sugars or carbohydrates (e.g., monosaccharides, disaccharides, or polysaccharides). In some embodiments, the carbon source is glucose and/or sucrose. In other embodiments, the carbon source is derived from a renewable feedstock such as carbohydrates from corn, sugar cane, or lignocellulosic biomass; or waste products such as glycerol, flu-gas, syn-gas; or the reformation of organic materials such as biomass or natural gas; or is carbon dioxide that is fixed photosynthetically. In other embodiments, a biomass is processed into a carbon source, which is suitable for bioconversion. In still other embodiments, the biomass does not require further processing into a carbon source but can be used directly as carbon source.

An exemplary source of such biomass is plant matter or vegetation, such as switchgrass. Another exemplary carbon source includes metabolic waste products, such as animal matter (e.g., cow manure). Further exemplary sources of carbon include algae and other marine plants. Another carbon source (including biomass) includes waste products from industry, agriculture, forestry, and households, including, but not limited to, fermentation waste, fermentation biomass, glycerol/glycerine, ensilage, straw, lumber, sewage, garbage, maniple solid waste, cellulosic urban waste, and food leftovers.

As used herein, the term "isolated," with respect to products such as ω-OH fatty acids and derivatives thereof refers to products that are separated from cellular components, cell culture media, or chemical or synthetic precursors. The fatty acids and derivatives thereof (e.g., ω-OH fatty acid and/or ω-OH fatty acid derivatives) produced by the methods described herein can be relatively immiscible in the fermentation broth, as well as in the cytoplasm. Therefore, the fatty acids and derivatives thereof can collect in an organic phase either intracellularly or extracellularly.

As used herein, the terms "purify," "purified," or "purification" mean the removal or isolation of a molecule from its environment by, for example, isolation or separation. "Substantially purified" molecules are at least about 60% free (e.g., at least about 70% free, at least about 75% free, at least about 85% free, at least about 90% free, at least about 95% free, at least about 97% free, at least about 99% free) from other components with which they are associated. As used herein, these terms also refer to the removal of contaminants from a sample. For example, the removal of contaminants can result in an increase in the percentage of fatty acid derivatives such as ω-OH fatty acid and/or ω-OH fatty acid derivatives in a sample. For example, when a fatty acid derivative is produced in a recombinant host cell, the fatty acid derivative can be purified by the removal of host cell proteins or other host cell materials. After purification, the percentage of fatty acid derivative in the sample is increased. The terms "purify", "purified," and "purification" are relative terms which do not require absolute purity. Thus, for example, when a fatty acid derivative is produced in recombinant host cells, a purified fatty acid derivative is a fatty acid derivative that is substantially separated from other cellular components (e.g., nucleic acids, polypeptides, lipids, carbohydrates, or other hydrocarbons).

Omega-Hydroxylated Fatty Acid and Fatty Acid Derivative Production as a Result of CYP153A-Reductase Hybrid Fusion Polypeptide Variant Expression in Cells Beneficial mutations identified in the saturation library of the catalytic domain (Example 7) were the basis of a combination library to further improve cyp153A(G307A)-Red450RhF(A796V) fusion protein. The selection criteria for hits was (1) an increased amount of ω-hydroxy fatty acids (ω-OH FFA titer); and/or (2) increased conversion of fatty acids to ω-hydroxy fatty acids. The improved variants are shown in Table 12 below, in particular, variants that significantly improved ω-hydroxy fatty acid formation.

TABLE 12

Summary of improved variants from a combination library of the catalytic domain of cyp153A(G307A)-Red450RhF(A796V) (SEQ ID NO: 38)

| P450 mutation | SEQ ID | ω-OH FFA | FAS | % ω-OH FFA | FOIC |
|---|---|---|---|---|---|
| Q12W, R27L, K119R, S140N, S157R, V159M, S233L, A244R | 98 | 1197.3 | 1610.1 | 74.4 | 3.3 |
| Q12R, Q28M, N61L, K119R, A231V, N309S, Y413R, I480G | 100 | 1227.6 | 1748.6 | 70.2 | 3.1 |
| Q12R, K119R, A231V, I480G | 102 | 1156.0 | 1699.8 | 68.0 | 3.0 |
| Q12T, Q28M, R77Q, K119R, V141T, A231W, N407G | 104 | 1204.3 | 1929.1 | 62.4 | 2.8 |
| Q12R, Q28M, N61L, V141T, A231Y, N407G | 106 | 1153.2 | 1909.9 | 60.4 | 2.7 |
| Q12W, Q28M, K119R, A231Y, A244R | 108 | 1007.9 | 1637.8 | 61.5 | 2.7 |
| Q12W, Q28T, N407G, I480G | 110 | 904.0 | 1478.9 | 61.1 | 2.7 |
| Q12R, V141T, A231Y, Y413R, G481I | 112 | 1043.2 | 1733.6 | 60.2 | 2.7 |
| Q12T, Q28M, F111A, A231V, N407G | 114 | 1029.3 | 1713.8 | 60.1 | 2.6 |
| Q12T, Q28M, N61L, S140N, P149R | 116 | 890.9 | 1536.8 | 58.0 | 2.6 |
| Control: SEQ ID NO: 38 | 38 | 427.8 | 1889.1 | 22.7 | 1.0 |

FOIC: Fold improvement over control; control is bold

Beneficial mutations identified in the combinatorial library of the catalytic domain (see Example 8, supra) were the basis for the next round of a combination library to further improve the cyp153A(G307A)-Red450RhF(A796V) fusion protein (Combinatorial library of the catalytic domain of cyp153A(G307A)-Red450RhF(A796V) fusion protein at high expression level). The selection criteria for hits was (1) an increased amount of ω-hydroxy fatty acids (ω-OH FFA titer); and/or (2) increased conversion of fatty acids to ω-hydroxy fatty acids. The improved variants are shown in Table 12 below, in particular, variants that significantly improved ω-hydroxy fatty acid formation.

TABLE 13

Summary of improved variants at higher expression level from a combination library of the catalytic domain of cyp153A(G307A)-Red450RhF(A796V)

| P450 mutations | SEQ ID | ω-OH FFA | FAS | % ω-OH FFA | FOIC |
|---|---|---|---|---|---|
| Q12W, Q28T, R77Q, K119R, V159M, A231Y, R254G, N407G, I480G | 118 | 471.5 | 573.9 | 82.2 | 1.5 |
| Q12W, Q28T, R254G, N309S, N407G, V451M | 120 | 468.8 | 598.8 | 78.5 | 1.4 |
| Q12W, Q28T, R254G, N309S, N407G, I480G | 122 | 426.6 | 546.6 | 78.1 | 1.4 |
| Q12W, Q28T, N309S, N407G, V451M, I480G | 124 | 404.5 | 526.1 | 76.9 | 1.4 |
| Control: SEQ ID NO: 38 | 38 | 279.0 | 503.9 | 55.4 | 1.0 |

FOIC: Fold improvement over control; control is bold

Beneficial mutations identified in the saturation library of the reductase domain (Example 7) were the basis of a combination library to further improve the cyp153A (G307A)-Red450RhF(A796V) fusion protein. The selection criteria was (1) an increased amount of ω-hydroxy fatty acids (ω-OH FFA titer); and/or (2) increased conversion of fatty acids to ω-hydroxy fatty acids. The improved variants are shown in Table 14.

TABLE 14

Improved variants from a combinatorial library of the reductase domain of cyp153A(G307A)-Red450RhF(A796V)

| RhF domain mutation | SEQ ID | ω-OH FFA | FAS | % ω-OH FFA | FOIC |
|---|---|---|---|---|---|
| D527E, D544N, R719W, E757A, V771F, M784I | 126 | 1223.3 | 2222.6 | 55.0 | 2.1 |
| D527E, D544N, E557R | 128 | 1167.3 | 2197.3 | 53.1 | 2.0 |
| T770G, M784I | 130 | 1083.0 | 2084.5 | 52.0 | 2.0 |
| D527E, E591Q, V648L, R719W, E757A, V771F, M784I | 132 | 1191.5 | 2264.0 | 52.6 | 1.9 |
| D527E, E591Q, V648E, E757A, V771F | 134 | 1053.1 | 2056.3 | 51.2 | 1.9 |
| D527E, D544N, T770G, M784I | 136 | 1064.7 | 2100.3 | 50.7 | 1.9 |
| D527E, E557R, T770G, M784I | 138 | 1061.0 | 2068.1 | 51.3 | 1.9 |
| E557W, E757A, T770G | 140 | 1105.0 | 2156.9 | 51.2 | 1.9 |
| E557R, E757A, V771F | 142 | 1065.4 | 2153.7 | 49.5 | 1.9 |
| E757A, T770G | 144 | 1032.3 | 2079.9 | 49.6 | 1.8 |
| Control: SEQ ID NO: 38 | 38 | 610.4 | 2277.2 | 26.8 | 1.0 |

FOIC: Fold improvement over control; control is bold

Beneficial mutations identified in the combinatorial libraries of the catalytic and reductase domains (see Examples 8-10, supra) were the basis for a combination library to further improve the cyp153A(Q12W, R27L, K119R, S140N, S157R, V159M, S233L, A244R, G307A)-Red450RhF(A796V) fusion protein (Combinatorial library of the catalytic and reductase domain of cyp153A(Q12W, R27L, K119R, S140N, S157R, V159M, S233L, A244R, G307A)-Red450RhF(A796V) fusion protein (SEQ ID NO: 98)). The selection criteria was (1) an increased amount of ω-hydroxy fatty acids (ω-OH FFA titer); and/or (2) increased conversion of fatty acids to ω-hydroxy fatty acids. The improved variants are shown in Table 15.

TABLE 15

Improved variants from a combinatorial library of the catalytic and reductase domain of the cyp153A(Q12W, R27L, K119R, S140N, S157R, V159M, S233L, A244R, G307A)-Red450RhF(A796V) fusion protein (SEQ ID NO: 98)

| P450 mutations | RhF domain mutations | SEQ ID NO: | ω-OH FFA | FAS | % ω-OH FFA | FOIC |
|---|---|---|---|---|---|---|
| V141T, A231Y, N407G | | 146 | 1406.6 | 3101.0 | 45.4 | 1.5 |
| V141T, A231Y, L233S, R254G | | 148 | 1200.9 | 2858.6 | 42.0 | 1.4 |
| A231Y, N407G, V451M | E757A, T770G, M784I | 150 | 855.2 | 2048.1 | 41.8 | 1.4 |
| V141T, A231Y, L233S, R244A | | 152 | 1189.8 | 2912.9 | 40.8 | 1.4 |
| V141T, A231Y, R244A, V451M | E557W, E749L, T770G | 154 | 1142.5 | 2773.8 | 41.2 | 1.4 |
| L27R, Q28M, N61L, V141T, P149G, A231Y | | 156 | 1207.5 | 2983.3 | 40.5 | 1.3 |
| V141T, R157S, A231Y, L233S, R244A | E757A, M784I | 158 | 1250.2 | 3075.4 | 40.7 | 1.3 |
| A231Y, N407G | E591Q, R643H, E757A, M784I | 160 | 1101.6 | 2730.0 | 40.4 | 1.3 |
| Q28M, N61L, N140S, V141T, A231Y, L233S, E271D | | 162 | 1168.9 | 2984.3 | 39.2 | 1.3 |
| A231Y, L233S, R254G | E557W | 164 | 1101.4 | 2869.8 | 38.4 | 1.3 |
| Control: SEQ ID NO: 98 | | 98 | 882.4 | 2940.5 | 30.0 | 1.0 |

FOIC: Fold improvement over control; control is bold

In view of Tables 12-15, in various embodiments a CYP153A-reductase hybrid fusion polypeptide variant of the disclosure provides for an increased amount of ω-hydroxy fatty acids (ω-OH FFA titer) as compared to the CYP153A-reductase hybrid fusion polypeptide of, e.g., SEQ ID NO: 38 or SEQ ID NO: 98, when catalyzing the conversion of a fatty acid (derivative) to an ω-hydroxylated fatty acid or ω-OH fatty acid derivative. Thus, in various embodiments, a CYP153A-reductase hybrid fusion polypeptide variant of the disclosure provides for an increased conversion of a fatty acid (derivative) to an ω-hydroxy fatty acid or ω-OH fatty acid derivative as compared to the CYP153A-reductase hybrid fusion polypeptide of, e.g., SEQ ID NO: 38 or SEQ ID NO: 98.

The disclosure provides for the production of ω-OH fatty acids and ω-OH fatty acid derivatives in a host cell. The ω-OH fatty acid production may be enhanced as a result of the expression of a CYP153A-reductase hybrid fusion polypeptide variant. The CYP153A-reductase hybrid fusion polypeptide variant produces ω-OH fatty acid derivatives at a higher titer when compared to a template CYP153A-reductase hybrid fusion polypeptide, e.g., when compared to the CYP153A-reductase hybrid fusion polypeptide of, e.g., SEQ ID NO: 6 or SEQ ID NO: 38. In various embodiments, a CYP153A-reductase hybrid fusion polypeptide variant of the present disclosure produces ω-OH fatty acid derivatives at a higher titer when compared to the CYP153A-reductase hybrid fusion polypeptide of, e.g., SEQ ID NO: 42 and/or SEQ ID NO: 46. In various embodiments, a CYP153A-reductase hybrid fusion polypeptide variant of the present disclosure produces ω-OH fatty acid derivatives at a higher titer when compared to the CYP153A-reductase hybrid fusion polypeptide of, e.g., SEQ ID NO: 98. The CYP153A-reductase hybrid fusion polypeptide variant is involved in a biosynthetic pathway for the production of ω-OH fatty acid derivatives; it may be used alone or in combination with other enzymes. For example, the CYP153A-reductase hybrid fusion polypeptide variant can be used in an engineered biosynthetic pathway wherein a thioesterase (i.e., naturally or heterologously/exogenously expressed) enzyme converts an acyl-ACP or acyl-CoA to a fatty acid. The CYP153A-reductase hybrid fusion polypeptide variant can then convert the fatty acid to an ω-OH fatty acid (see FIG.

1). Additional enzymes in the pathway can convert ω-OH fatty acids into other bi-functional fatty acid derivatives such as α,ω-diacids.

More specifically, a CYP153A-reductase hybrid fusion polypeptide is a polypeptide sequence that has at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to SEQ ID NO: 6 and serves as a template sequence to introduce mutations in order to create variants with improved enzymatic activity for the production of ω-OH fatty acids and fatty acid derivatives. The CYP153A-reductase hybrid fusion polypeptide of SEQ ID NO: 6 is a P450 Cyp153A(G307A)-RedRhF fusion protein that has a mutation in the catalytic domain at position 307 where a glycine is substituted with an alanine (see FIG. 3). This protein is self-sufficient and possesses ω-hydroxylase enzymatic activity that catalyzes the reaction of a fatty acid to an ω-OH fatty acid.

In various embodiments of the present disclosure, a CYP153A-reductase hybrid fusion polypeptide variant provided by the present disclosure is self-sufficient and possesses ω-hydroxylase enzymatic activity that catalyzes the reaction of a fatty acid (derivative) to an ω-OH fatty acid (derivative). In various embodiments of the present disclosure, a CYP153A-reductase hybrid fusion polypeptide variant provided by the present disclosure possesses an ω-hydroxylase enzymatic activity that catalyzes the reaction of a fatty acid (derivative) to an ω-OH fatty acid (derivative), which is higher as compared to the ω-hydroxylase enzymatic activity of a CYP153A-reductase hybrid fusion polypeptide of, e.g., SEQ ID NO: 6 or SEQ ID NO: 38. In various embodiments of the present disclosure, a CYP153A-reductase hybrid fusion polypeptide variant provided by the present disclosure possesses an ω-hydroxylase enzymatic activity that catalyzes the reaction of a fatty acid (derivative) to an ω-OH fatty acid (derivative), which is higher as compared to the ω-hydroxylase enzymatic activity of a CYP153A-reductase hybrid fusion polypeptide of, e.g., SEQ ID NO: 42 or SEQ ID NO: 46. In various embodiments of the present disclosure, a CYP153A-reductase hybrid fusion polypeptide variant provided by the present disclosure possesses an ω-hydroxylase enzymatic activity that catalyzes the reaction of a fatty acid (derivative) to an ω-OH fatty acid (derivative), which is higher as compared to the ω-hydroxylase enzymatic activity of a CYP153A-reductase hybrid fusion polypeptide of, e.g., SEQ ID NO: 98.

In one embodiment, a CYP153A-reductase hybrid fusion polypeptide variant refers to a modified CYP153A-reductase hybrid fusion polypeptide that has at least one additional mutation in its reductase domain including, but not limited to, a mutation at amino acid position 796, 141, 231, 27, 82, 178, 309, 407, 415, 516 and/or 666 or a combination thereof. The expression of the CYP153A-reductase hybrid fusion polypeptide variant in recombinant host cells results in improved titer, yield and/or productivity of ω-OH fatty acids and/or ω-OH fatty acid derivatives or compositions thereof when compared to the expression of the CYP153A-reductase hybrid fusion polypeptide in a corresponding host cell.

An example of a CYP153A-reductase hybrid fusion polypeptide variant is SEQ ID NO: 38, which has one additional mutation in the reductase domain in position 796, where an alanine is replaced with a valine (see FIG. 4). This CYP153A-reductase hybrid fusion polypeptide variant has a polypeptide sequence that has at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to SEQ ID NO: 38 and it further serves as a template sequence to create additional mutations to provide additional variants. The CYP153A-reductase hybrid fusion polypeptide variant of SEQ ID NO: 38 is a P450 Cyp153A(G307A)-RedRhF(A796V) fusion protein (see FIG. 5), has one mutation in the catalytic domain (G307A), has one mutation in the reductase domain (A796V), is self-sufficient and possesses ω-hydroxylase enzymatic activity that catalyzes the reaction of a fatty acid to an ω-OH fatty acid. In one embodiment, the CYP153A-reductase hybrid fusion polypeptide variant is a modified CYP153A-reductase hybrid fusion polypeptide that has at least one additional mutation in its amino acid sequence in its catalytic and/or reductase domain including, but not limited to, a mutation at amino acid position 9, 10, 11, 12, 13, 14, 27, 28, 61, 77, 119, 140, 141, 149, 157, 159, 231, 233, 244, 254, 271, 309, 327, 407, 413, 451, 480, 527, 544, 557, 567, 591, 648, 649, 703, 706, 719, 745, 747, 749, 757, 770, 771 and 784 or a combination thereof (see, e.g., SEQ ID NOS: 47-164 referring to nucleic acid and protein sequences of such CYP153A-reductase hybrid fusion polypeptide variants). In one embodiment, the expression of a CYP153A-reductase hybrid fusion polypeptide variant in a recombinant host cell results in an improved titer, yield and/or productivity of ω-OH fatty acids and/or ω-OH fatty acid derivatives when compared to the expression of the CYP153A-reductase hybrid fusion polypeptide variant of SEQ ID NO: 38 (i.e., template variant) in a corresponding host cell. In another embodiment, the expression of a CYP153A-reductase hybrid fusion polypeptide variant in a recombinant host cell results in an improved titer, yield and/or productivity of ω-OH fatty acids and/or ω-OH fatty acid derivatives when compared to the expression of the CYP153A-reductase hybrid fusion polypeptide of SEQ ID NO: 6 (i.e., template polypeptide). In one embodiment, the expression of a CYP153A-reductase hybrid fusion polypeptide variants in a recombinant host cell results in an improved titer, yield and/or productivity of ω-OH fatty acids and/or ω-OH fatty acid derivatives when compared to the expression of the CYP153A-reductase hybrid fusion polypeptide variant of, e.g., SEQ ID NO: 42 in a corresponding host cell. In one embodiment, the expression of a CYP153A-reductase hybrid fusion polypeptide variant in a recombinant host cell results in an improved titer, yield and/or productivity of ω-OH fatty acids and/or ω-OH fatty acid derivatives when compared to the expression of the CYP153A-reductase hybrid fusion polypeptide variant of, e.g., SEQ ID NO: 46 in a corresponding host cell. In one embodiment, the expression of a CYP153A-reductase hybrid fusion polypeptide variant in a recombinant host cell results in an improved titer, yield and/or productivity of ω-OH fatty acids and/or ω-OH fatty acid derivatives when compared to the expression of the CYP153A-reductase hybrid fusion polypeptide variant of, e.g., SEQ ID NO: 98 in a corresponding host cell.

When a cell has been transformed with a CYP153A-reductase hybrid fusion polypeptide variant it is a cell that expresses the CYP153A-reductase hybrid fusion polypeptide variant (e.g., a recombinant cell). In one embodiment, the titer and/or yield of an ω-OH fatty acid produced by a cell that expresses the CYP153A-reductase hybrid fusion polypeptide variant is at least twice that of a corresponding cell that expresses the CYP153A-reductase hybrid fusion polypeptide. In another embodiment, the titer and/or yield of an ω-OH fatty acid produced by a cell that expresses a CYP153A-reductase hybrid fusion polypeptide variant of the disclosure is at least twice that of a corresponding cell that expresses the CYP153A-reductase hybrid fusion polypeptide template variant, in particular the CYP153A-reductase hybrid fusion polypeptide of SEQ ID NO: 6 or SEQ ID NO: 38. In another embodiment, the titer and/or yield of an ω-OH fatty acid produced by a cell that expresses a CYP153A-reductase hybrid fusion polypeptide variant of the disclosure is at least twice that of a corresponding cell that expresses the CYP153A-reductase hybrid fusion polypeptide of, e.g., SEQ ID NO: 42 or SEQ ID NO: 46. In another embodiment, the titer and/or yield of an ω-OH fatty acid produced by a cell that expresses a CYP153A-reductase hybrid fusion polypeptide variant of the disclosure is at least twice that of a corresponding cell that expresses the CYP153A-reductase hybrid fusion polypeptide of, e.g., SEQ ID NO: 98. In a host such as *Escherichia coli*, ω-OH fatty acids may be converted to bi-functional fatty acid derivatives by naturally or heterologously expressed enzymes. In another embodiment, the titer and/or yield of an ω-OH fatty acid or derivative thereof produced by a cell that expresses the CYP153A-reductase hybrid fusion polypeptide variant is at least about 1 times, at least about 2 times, at least about 3 times, at least about 4 times, at least about 5 times, at least about 6 times, at least about 7 times, at least about 8 times, at least about 9 times, or at least about 10 times greater than that of a corresponding cell that expresses the CYP153A-reductase hybrid fusion polypeptide. In another embodiment, the titer and/or yield of an ω-OH fatty acid or derivative thereof produced by a cell that expresses a CYP153A-reductase hybrid fusion polypeptide variant of the disclosure is at least about 1 times, at least about 2 times, at least about 3 times, at least about 4 times, at least about 5 times, at least about 6 times, at least about 7 times, at least about 8 times, at least about 9 times, or at least about 10 times greater than that of a corresponding cell that expresses the CYP153A-reductase hybrid fusion polypeptide template variant, in particular the CYP153A-reductase hybrid fusion polypeptide of SEQ ID NO: 6 or SEQ ID NO: 38. In another embodiment, the titer and/or yield of an ω-OH fatty acid produced by a cell that expresses a CYP153A-reductase hybrid fusion polypeptide variant of the disclosure is at least twice that of a corresponding cell that expresses the CYP153A-reductase hybrid fusion polypeptide of, e.g., SEQ ID NO: 42 or SEQ ID NO: 46. In another embodiment, the titer and/or yield of an ω-OH fatty acid produced by a cell that expresses a CYP153A-reductase hybrid fusion polypeptide variant of the disclosure is at least twice that of a corresponding cell that expresses the CYP153A-reductase hybrid fusion polypeptide of, e.g., SEQ ID NO: 98. In one embodiment, the titer and/or yield of an ω-OH fatty acid or derivative thereof produced by a cell expressing a CYP153A-reductase hybrid fusion polypeptide variant of the disclosure is at least about 1 percent, at least about 2 percent, at least about 3 percent, at least about 4 percent, at least about 5 percent, at least about 6 percent, at least about 7 percent, at least about 8 percent, at least about 9 percent, or at least about 10 percent greater than that of a corresponding cell that expresses a template or reference CYP153A-reductase hybrid fusion polypeptide, e.g., that expresses the CYP153A-reductase hybrid fusion polypeptide of, e.g., SEQ ID NO: 6 or SEQ ID NO: 38. In another embodiment, the titer and/or yield of an ω-OH fatty acid or derivative thereof produced by a cell expressing a CYP153A-reductase hybrid fusion polypeptide variant of the disclosure is at least about 1 percent, at least about 2 percent, at least about 3 percent, at least about 4 percent, at least about 5 percent, at least about 6 percent, at least about 7 percent, at least about 8 percent, at least about 9 percent, or at least about 10 percent greater than that of a corresponding cell that expresses the CYP153A-reductase hybrid fusion polypeptide template variant of, e.g., SEQ ID NO: 42 or SEQ ID NO: 46. In another embodiment, the titer and/or yield of an ω-OH fatty acid or derivative thereof produced by a cell expressing a CYP153A-reductase hybrid fusion polypeptide variant of the disclosure is at least about 1 percent, at least about 2 percent, at least about 3 percent, at least about 4 percent, at least about 5 percent, at least about 6 percent, at least about 7 percent, at least about 8 percent, at least about 9 percent, or at least about 10 percent greater than that of a corresponding cell that expresses the CYP153A-reductase hybrid fusion polypeptide template variant of, e.g., SEQ ID NO: 98.

In another embodiment, the titer and/or yield of an r-OH fatty acid or derivative thereof produced in a recombinant cell due to the expression of a CYP153A-reductase hybrid fusion polypeptide variant is at least about 20 percent to at least about 80 percent greater than that of a corresponding cell that expresses the CYP153A-reductase hybrid fusion polypeptide of, e.g., SEQ ID NO: 6 or SEQ ID NO: 38. In another embodiment, the titer and/or yield of an ω-OH fatty acid or derivative thereof produced in a recombinant cell due to the expression of a CYP153A-reductase hybrid fusion polypeptide variant is at least about 20 percent to at least about 80 percent greater than that of a corresponding cell that expresses the CYP153A-reductase hybrid fusion polypeptide of, e.g., SEQ ID NO: 42 or SEQ ID NO: 46. In another embodiment, the titer and/or yield of an ω-OH fatty acid or derivative thereof produced in a recombinant cell due to the expression of a CYP153A-reductase hybrid fusion polypeptide variant is at least about 20 percent to at least about 80 percent greater than that of a corresponding cell that expresses the CYP153A-reductase hybrid fusion polypeptide of, e.g., SEQ ID NO: 98.

In some embodiments, the titer and/or yield of an ω-OH fatty acid produced by a cell is at least about 20 percent, at least about 25 percent, at least about 30 percent, at least about 35 percent, at least about 40 percent, at least about 45 percent, at least about 50 percent, at least about 55 percent, at least about 60 percent, at least about 65 percent, at least about 70 percent, at least about 75 percent, at least about 80 percent, at least about 85 percent, at least about 90 percent, at least about 95 percent, at least about 97 percent, at least about 98 percent, or at least about 100 percent greater than that of the corresponding cell that expresses the CYP153A-reductase hybrid fusion polypeptide. In other embodiments, the titer and/or yield of an ω-OH fatty acid produced by a cell or a recombinant microorganism of the disclosure is at least about 20 percent, at least about 25 percent, at least about 30 percent, at least about 35 percent, at least about 40 percent, at least about 45 percent, at least about 50 percent, at least about 55 percent, at least about 60 percent, at least about 65 percent, at least about 70 percent, at least about 75 percent, at least about 80 percent, at least about 85 percent, at least about 90 percent, at least about 95 percent, at least about 97 percent, at least about 98 percent, or at least about 100 percent greater than that of the corresponding cell that expresses the CYP153A-reductase hybrid fusion polypeptide template variant, in particular the CYP153A-reductase hybrid fusion polypeptide of, e.g., SEQ ID NO: 6 or SEQ ID NO: 38. In other embodiments, the titer and/or yield of an ω-OH fatty acid produced by a cell or a recombinant microorganism of the present disclosure is at least about 20 percent, at least about 25 percent, at least about 30 percent, at least about 35 percent, at least about 40 percent, at least about 45 percent, at least about 50 percent, at least about 55 percent, at least about 60 percent, at least about 65 percent, at least about 70 percent, at least about 75 percent, at least about 80 percent, at least about 85 percent, at least about 90 percent, at least about 95 percent, at least about 97 percent, at least about 98 percent, or at least about 100 percent greater than that of the corresponding cell that expresses the CYP153A-reductase hybrid fusion polypeptide of, e.g., SEQ ID NO: 42 or SEQ ID NO: 46. In other embodiments, the titer and/or yield of an ω-OH fatty acid produced by a cell or a recombinant microorganism of the present disclosure is at least about 20 percent, at least about 25 percent, at least about 30 percent, at least about 35 percent, at least about 40 percent, at least about 45 percent, at least about 50 percent, at least about 55 percent, at least about 60 percent, at least about 65 percent, at least about 70 percent, at least about 75 percent, at least about 80 percent, at least about 85 percent, at least about 90 percent, at least about 95 percent, at least about 97 percent, at least about 98 percent, or at least about 100 percent greater than that of the corresponding cell that expresses the CYP153A-reductase hybrid fusion polypeptide of, e.g., SEQ ID NO: 98.

Thus, the disclosure provides recombinant host cells, which have been engineered to express a CYP153A-reductase hybrid fusion polypeptide variant of the present disclosure to produce ω-OH fatty acids or derivatives thereof. Examples of such variants are depicted in Sequence Tables A, B and C (infra). In one embodiment, the biosynthesis of ω-OH fatty acids is enhanced relative to the CYP153A-reductase hybrid fusion polypeptide-expressing host cells, i.e., host cells that express the CYP153A-reductase hybrid fusion polypeptide based on, e.g., SEQ ID NO: 6, SEQ ID NO: 38, SEQ ID NO: 42, or SEQ ID NO: 46, or other polypeptides with the same enzymatic function. In one embodiment, the biosynthesis of ω-OH fatty acids is enhanced relative to the CYP153A-reductase hybrid fusion polypeptide-expressing host cells, i.e., host cells that express the CYP153A-reductase hybrid fusion polypeptide based on, e.g., SEQ ID NO: 98. In another embodiment, the biosynthesis of ω-OH fatty acids is enhanced relative to the CYP153A-reductase hybrid fusion polypeptide template variant-expressing host cells, i.e., host cells that express the CYP153A-reductase hybrid fusion polypeptide based on SEQ ID NO: 38 or other polypeptides with the same enzymatic function. In another embodiment, the biosynthesis of ω-OH fatty acids is enhanced relative to the CYP153A-reductase hybrid fusion polypeptide template variant-expressing host cells, i.e., host cells that express the CYP153A-reductase hybrid fusion polypeptide based on SEQ ID NO: 6 or other polypeptides with the same enzymatic function. In another embodiment, the biosynthesis of ω-OH fatty acids is enhanced relative to the CYP153A-reductase hybrid fusion polypeptide template variant-expressing host cells, i.e., host cells that express the CYP153A-reductase hybrid fusion polypeptide based on, e.g., SEQ ID NO: 42 or other polypeptides with the same enzymatic function. In another embodiment, the biosynthesis of ω-OH fatty acids is enhanced relative to the CYP153A-reductase hybrid fusion polypeptide template variant-expressing host cells, i.e., host cells that express the CYP153A-reductase hybrid fusion polypeptide based on, e.g., SEQ ID NO: 46 or other polypeptides with the same enzymatic function. In another embodiment, the biosynthesis of ω-OH fatty acids is enhanced relative to the CYP153A-reductase hybrid fusion polypeptide template variant-expressing host cells, i.e., host cells that express the CYP153A-reductase hybrid fusion polypeptide based on, e.g., SEQ ID NO: 98 or other polypeptides with the same enzymatic function. A variety of different host cells can be modified to express a CYP153A-reductase hybrid fusion polypeptide variant such as those described herein, resulting in recombinant host cells suitable for the enhanced production of ω-OH fatty acid and ω-OH fatty acid derivatives or compositions thereof. Examples of ω-OH fatty acids that are produced are $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids. In one embodiment, such ω-OH fatty acids are ω-OH $C_{8:0}$ fatty acids, ω-OH $C_{10:0}$ fatty acids, ω-OH $C_{12:0}$ fatty acids, ω-OH $C_{14:0}$ fatty acids, ω-OH $C_{16:0}$ fatty acids, ω-OH $C_{18:0}$ fatty acids, ω-OH $C_{20:0}$ fatty acids, ω-OH $C_{8:1}$ fatty acids, ω-OH $C_{10:1}$ fatty acids, ω-OH $C_{12:1}$ fatty acids, ω-OH $C_{14:1}$ fatty acids, ω-OH $C_{16:1}$ fatty acids, ω-OH $C_{18:1}$ fatty acids, ω-OH $C_{20:1}$ fatty acids, and the like. It is understood that a variety of cells can provide sources of genetic material, including polynucleotide sequences that encode polypeptides suitable for use in a recombinant host cell as described herein.

Pathway Engineering and Enzymatic Activities

Fatty acid synthesis is one of the most conserved systems of the bacterial biosynthetic machinery. The fatty acid synthase (FAS) multi-enzyme complex is present in all bacteria and eukaryotes. Most of the FAS related genes are indispensable for cell growth and survival. Eukaryotic and bacterial FAS drive essentially the same type of biochemical transformation. In eukaryotes, FAS is referred to as FAS I and most of its catalytic domains are encoded by one polypeptide chain (non-dissociable). In prokaryotes such as bacteria, FAS is referred to as FASII and its individual enzymes and carrier proteins are encoded by separate genes coding for discrete (dissociable) proteins. As such, FASII is a complex system with significant variations and distinct peculiarities.

The acyl carrier protein (ACP) along with the enzymes in a FAS pathway control the length, degree of saturation and branching of the fatty acids produced in a native organism. The steps in this pathway are catalyzed by enzymes of the fatty acid biosynthesis (FAB) and acetyl-CoA carboxylase (ACC) gene families. For example, enzymes that can be included in a FAS pathway include AccABCD, FabD, FabH, FabG, FabA, FabZ, FabI, FabK, FabL, FabM, FabB, and FabF. Depending upon the desired product one or more of these genes can be attenuated or over-expressed. As such, prokaryotes have been engineered to increase production of fatty acid derivatives from renewable feedstock such as glucose or other carbon sources. Herein the major goal is to increase the activity of key control enzymes that regulate the production of fatty acid derivatives in order to convert the bacterial strain into a microbial factory for fatty acid derivative production, including fatty acid methyl esters (FAMEs), fatty acid ethyl esters (FAEEs), and fatty alcohols (FALC) (see, e.g., U.S. Pat. No. 8,283,143, incorporated by reference herein).

The present disclosure identifies CYP153A-reductase hybrid fusion polynucleotides that encode polypeptides of enzymatic function in order to modify enzymatic pathways for the production of desirable compounds such as ω-OH fatty acids and ω-OH fatty acid derivatives. These polypeptides, which are identified herein by Enzyme Accession Numbers (EC Numbers), are useful for engineering fatty acid pathways that lead to production of ω-OH fatty acids and other bi-functional molecules such as ω-OH fatty acid derivatives like α,ω-diacids (see FIG. 1).

In one embodiment, pathways are depicted in FIG. 1 that use a carbon source derived from a renewable feedstock such as glucose to produce ω-OH fatty acid derivatives. A carbohydrate (e.g., glucose) is converted to an acyl-thioester such as an acyl-ACP by the native organism (see step 1 in FIG. 1). Polynucleotides that code for polypeptides with fatty acid degradation enzyme activity can be optionally attenuated depending on the desired product (see Examples, infra). Non-limiting examples of such polypeptides are acyl-CoA synthetase (FadD) and acyl-CoA dehydrogenase (FadE). Table 1 provides a comprehensive list of enzymatic activity (infra) within the metabolic pathway, including various fatty acid degradation enzymes that can be optionally attenuated according to methods known in the art (see, e.g., U.S. Pat. No. 8,283,143, supra).

For example, FadR (see Table 1, infra) is a key regulatory factor involved in fatty acid degradation and fatty acid biosynthetic pathways (Cronan et al., *Mol. Microbiol.*, 29(4): 937-943 (1998)). The *E. coli* enzyme FadD (see Table 1, infra) and the fatty acid transport protein FadL are components of a fatty acid uptake system. FadL mediates transport of fatty acids into the bacterial cell, and FadD mediates formation of acyl-CoA esters. When no other carbon source is available, exogenous fatty acids are taken up by bacteria and converted to acyl-CoA esters, which can bind to the transcription factor FadR and depress the expression of the fad genes that encode proteins responsible for fatty acid transport (FadL), activation (FadD), and β-oxidation (FadA, FadB, and FadE). When alternative sources of carbon are available, bacteria synthesize fatty acids as acyl-ACPs, which are used for phospholipid synthesis, but are not substrates for P3-oxidation. Thus, acyl-CoA and acyl-ACP are both independent sources of fatty acids that can result in different end-products (Caviglia et al., *J. Biol. Chem.*, 279(12): 1163-1169 (2004)).

TABLE 1

Enzymatic Activities

| Gene Designation | Source Organism | Enzyme Name | Accession # | EC Number | Exemplary Use |
|---|---|---|---|---|---|
| | | Fatty Acid Production Increase | | | |
| accA | *E. coli*, *Lactococci* | Acetyl-CoA carboxylase, subunit A (carboxyltransferase alpha) | AAC73296, NP_414727 | 6.4.1.2 | increase Malonyl-CoA production |
| accB | *E. coli*, *Lactococci* | Acetyl-CoA carboxylase, subunit B (BCCP: biotin carboxyl carrier protein) | NP_417721 | 6.4.1.2 | increase Malonyl-CoA production |
| accC | *E. coli*, *Lactococci* | Acetyl-CoA carboxylase, subunit C (biotin carboxylase) | NP_417722 | 6.4.1.2, 6.3.4.14 | increase Malonyl-CoA production |
| accD | *E. coli*, *Lactococci* | Acetyl-CoA carboxylase, subunit D (carboxyltransferase beta) | NP_416819 | 6.4.1.2 | increase Malonyl-CoA production |
| fadD | *E. coli* W3110 | acyl-CoA synthase | AP_002424 | 2.3.1.86, 6.2.1.3 | increase Fatty acid production |
| fabA | *E. coli* K12 | β-hydroxydecanoyl thioester dehydratase/isomerase | NP_415474 | 4.2.1.60 | increase fatty acyl-ACP/CoA production |
| fabB | *E. coli* | 3-oxoacyl-[acyl-carrier-protein] synthase I | BAA16180 | 2.3.1.41 | increase fatty acyl-ACP/CoA production |
| fabD | *E. coli* K12 | [acyl-carrier-protein] S-malonyltransferase | AAC74176 | 2.3.1.39 | increase fatty acyl-ACP/CoA production |
| fabF | *E. coli* K12 | 3-oxoacyl-[acyl-carrier-protein] synthase II | AAC74179 | 2.3.1.179 | increase fatty acyl-ACP/CoA production |
| fabG | *E. coli* K12 | 3-oxoacyl-[acyl-carrier protein] reductase | AAC74177 | 1.1.1.100 | increase fatty acyl-ACP/CoA production |
| fabH | *E. coli* K12 | 3-oxoacyl-[acyl-carrier-protein] synthase III | AAC74175 | 2.3.1.180 | increase fatty acyl-ACP/CoA production |
| fabI | *E. coli* K12 | enoyl-[acyl-carrier-protein] reductase | NP_415804 | 1.3.1.9 | increase fatty acyl-ACP/CoA production |
| fabR | *E. coli* K12 | Transcriptional Repressor | NP_418398 | none | modulate unsaturated fatty acid production |
| fabV | *Vibrio cholerae* | enoyl-[acyl-carrier-protein] reductase | YP_001217283 | 1.3.1.9 | increase fatty acyl-ACP/CoA production |
| fabZ | *E. coli* K12 | (3R)-hydroxymyristol acyl carrier protein dehydratase | NP_414722 | 4.2.1.- | increase fatty acyl-ACP/CoA production |
| fadE | *E. coli* K13 | acyl-CoA dehydrogenase | AAC73325 | 1.3.99.3, 1.3.99.- | reduce fatty acid degradation |
| fadD | *E. coli* K12 | acyl-CoA synthetase | NP_416319 | 6.2.1.3 | reduce fatty acid degradation |

TABLE 1-continued

Enzymatic Activities

| Gene Designation | Source Organism | Enzyme Name | Accession # | EC Number | Exemplary Use |
|---|---|---|---|---|---|
| fadA | E. coli K12 | 3-ketoacyl-CoA thiolase | YP_02627 | 2.3.1.16 | reduce fatty acid degradation |
| fadB | E. coli K12 | enoyl-CoA hydratase, 3-OH acyl-CoA epimerase/ dehydrogenase | NP_418288 | 4.2.1.17, 5.1.2.3, 1.1.1.35 | reduce fatty acid degradation |
| fadR | E. coli | transcriptional regulatory protein | NP_415705 | none | Block or reverse fatty acid degradation |

Chain Length Control

| tesA (with or without leader sequence) | E. coli | thioesterase - leader sequence is amino acids 1-26 | P0ADA1 | 3.1.2.-, 3.1.1.5 | C18 Chain Length |
| tesA (without leader sequence) | E. coli | thioesterase | AAC73596, NP_415027 | 3.1.2.-, 3.1.1.5 | C18:1 Chain Length |
| tesA (mutant of E. coli thioesterase I complexed with octanoic acid) | E. coli | thioesterase | L109P | 3.1.2.-, 3.1.1.5 | <C18 Chain Length |
| fatB1 | Umbellularia californica | thioesterase | Q41635 | 3.1.2.14 | C12:0 Chain Length |
| fatB2 | Cuphea hookeriana | thioesterase | AAC49269 | 3.1.2.14 | C8:0-C10:0 Chain Length |
| fatB3 | Cuphea hookeriana | thioesterase | AAC72881 | 3.1.2.14 | C14:0-C16:0 Chain Length |
| fatB | Cinnamomumcamphora | thioesterase | Q39473 | 3.1.2.14 | C14:0 Chain Length |
| fatB | Arabidopsis thaliana | thioesterase | CAA85388 | 3.1.2.14 | C16:1 Chain Length |
| fatB1 | Umbellularia californica | thioesterase | Q41635 | 3.1.2.14 | C12:0 Chain Length |
| fatA1 | Helianthus annuus | thioesterase | AAL79361 | 3.1.2.14 | C18:1 Chain Length |
| fatA | Arabidopsis thaliana | thioesterase | NP_189147, NP_193041 | 3.1.2.14 | C18:1 Chain Length |
| fatA | Brassica juncea | thioesterase | CAC39106 | 3.1.2.14 | C18:1 Chain Length |
| fatA | Cuphea hookeriana | thioesterase | AAC72883 | 3.1.2.14 | C18:1 Chain Length |
| tes | Photbacterium profundum | thioesterase | YP_130990 | 3.1.2.14 | Chain Length |
| tesB | E. coli | thioesterase | NP_414986 | 3.1.2.14 | Chain Length |
| fadM | E. coli | thioesterase | NP_414977 | 3.1.2.14 | Chain Length |
| yciA | E. coli | thioesterase | NP_415769 | 3.1.2.14 | Chain Length |
| ybgC | E. coli | thioesterase | NP_415264 | 3.1.2.14 | Chain Length |

Saturation Level Control

| Sfa | E. coli | Suppressor of fabA | AAN79592, AAC44390 | none | increase mono-unsaturated fatty acids |
| fabA | E. coli K12 | β-hydroxydecanoyl thioester dehydratase/isomerase | NP_415474 | 4.2.1.60 | produce unsaturated fatty acids |
| GnsA | E. coli | suppressors of the secG null mutation | ABD 18647.1 | none | increase unsaturated fatty acid esters |
| GnsB | E. coli | suppressors of the secG null mutation | AAC74076.1 | none | increase unsaturated fatty acid esters |
| fabB | E. coli | 3-oxoacyl-[acyl-carrier-protein] synthase I | BAA16180 | 2.3.1.41 | modulate unsaturated fatty acid production |
| des | Bacillus subtilis | D5 fatty acyl desaturase | O34653 | 1.14.19 | modulate unsaturated fatty acid production |

Ester Production

| AT3G51970 | Arabidopsis thaliana | long-chain-alcohol O-fatty-acyltransferase | NP_190765 | 2.3.1.26 | ester production |
| ELO1 | Pichia angusta | Fatty acid elongase | BAD98251 | 2.3.1.- | produce very long chain length fatty acids |
| plsC | Saccharomyces cerevisiae | acyltransferase | AAA16514 | 2.3.1.51 | ester production |
| DAGAT/DGAT | Arabidopsis thaliana | diacylglycerol acyltransferase | AAF19262 | 2.3.1.20 | ester production |

TABLE 1-continued

| | | Enzymatic Activities | | | |
|---|---|---|---|---|---|
| Gene Designation | Source Organism | Enzyme Name | Accession # | EC Number | Exemplary Use |
| hWS | Homo sapiens | acyl-CoA wax alcohol acyltransferase | AAX48018 | 2.3.1.20 | ester production |
| aft1 | Acinetobacter sp. ADP1 | bifunctional wax ester synthase/acyl-CoA: diacylglycerol acyltransferase | AAO17391 | 2.3.1.20 | ester production |
| ES9 | Marinobacter hydrocarbonoclasticus | wax ester synthase | ABO21021 | 2.3.1.20 | ester production |
| mWS | Simmondsia chinensis | wax ester synthase | AAD38041 | 2.3.1.- | ester production |
| | | Fatty Alcohol Output | | | |
| | | thioesterases (see above) | | | increase fatty acid/fatty alcohol production |
| BmFAR | Bombyxmori | FAR (fatty alcohol forming acyl-CoA reductase) | BAC79425 | 1.1.1.- | convert acyl-CoA to fatty alcohol |
| acr1 | Acinetobacter sp. ADP1 | acyl-CoA reductase | YP_047869 | 1.2.1.42 | reduce fatty acyl-CoA to fatty aldehydes |
| yqhD | E. coli W3110 | alcohol dehydrogenase | AP_003562 | 1.1.-.- | reduce fatty aldehydes to fatty alcohols; increase fatty alcohol production |
| alrA | Acinetobacter sp. ADP1 | alcohol dehydrogenase | CAG70252 | 1.1.-.- | reduce fatty aldehydes to fatty alcohols |
| BmFAR | Bombyxmori | FAR (fatty alcohol forming acyl-CoA reductase) | BAC79425 | 1.1.1.- | reduce fatty acyl-CoA to fatty alcohol |
| GTNG_1865 | Geobacillus thermodenitrificans NG80-2 | Long-chain aldehyde dehydrogenase | YP_001125970 | 1.2.1.3 | reduce fatty aldehydes to fatty alcohols |
| AAR | Synechococcus elongatus | Acyl-ACP reductase | YP_400611 | 1.2.1.42 | reduce fatty acyl-ACP/CoA to fatty aldehydes |
| carB | Mycobacterium smegmatis | carboxylic acid reductase protein | YP_889972 | 6.2.1.3, 1.2.1.42 | reduce fatty acids to fatty aldehyde |
| FadD | E. coli K12 | acyl-CoA synthetase | NP_416319 | 6.2.1.3 | activates fatty acids to fatty acyl-CoAs |
| atoB | Erwiniacarotovora | acetyl-CoA acetyltransferase | YP_049388 | 2.3.1.9 | production of butanol |
| hbd | Butyrivibriofibrisolvens | Beta-hydroxybutyryl-CoA dehydrogenase | BAD51424 | 1.1.1.157 | production of butanol |
| CPE0095 | Clostridium perfringens | crotonasebutyryl-CoA dehydryogenase | BAB79801 | 4.2.1.55 | production of butanol |
| bcd | Clostridium beijerinckii | butyryl-CoA dehydryogenase | AAM14583 | 1.3.99.2 | production of butanol |
| ALDH | Clostridium beijerinckii | coenzyme A-acylating aldehyde dehydrogenase | AAT66436 | 1.2.1.3 | production of butanol |
| AdhE | E. coli CFT073 | aldehyde-alcohol dehydrogenase | AAN80172 | 1.1.1.1 1.2.1.10 | production of butanol |
| | | Fatty Alcohol Acetyl Ester Output | | | |
| | | thioesterases (see above) | | | modify output |
| acr1 | Acinetobacter sp. ADP1 | acyl-CoA reductase | YP_047869 | 1.2.1.42 | modify output |
| yqhD | E. Coli K12 | alcohol dehydrogenase | AP_003562 | 1.1.-.- | modify output |
| AAT | Fragaria x ananassa | alcohol O-acetyltransferase | AAG13130 | 2.3.1.84 | modify output |
| | | Terminal Olefin Output | | | |
| OleT | Jeotgalicoccus sp. | Fatty acid decarboxylase | HQ709266 | 1.11.2.4 | decarboxylate fatty acids |
| | | Product Export | | | |
| AtMRP5 | Arabidopsis thaliana | Arabidopsis thaliana multidrug resistance associated | NP_171908 | none | modify product export amount |
| AmiS2 | Rhodococcus sp. | ABC transporter AmiS2 | JC5491 | none | modify product export amount |
| AtPGP1 | Arabidopsis thaliana | Arabidopsis thaliana p glycoprotein 1 | NP_181228 | none | modify product export amount |

TABLE 1-continued

Enzymatic Activities

| Gene Designation | Source Organism | Enzyme Name | Accession # | EC Number | Exemplary Use |
|---|---|---|---|---|---|
| AcrA | CandidatusProtochlamydiaamoebophila UWE25 | putative multidrug-efflux transport protein acrA | CAF23274 | none | modify product export amount |
| AcrB | CandidatusProtochlamydiaamoebophila UWE25 | probable multidrug-efflux transport protein, acrB | CAF23275 | none | modify product export amount |
| TolC | Francisellatulartnsis subsp. novicida | Outer membrane protein [Cell envelope biogenesis, | ABD59001 | none | modify product export amount |
| AcrE | Shigellasonnei Ss046 | transmembrane protein affects septum formation and cell membrane permeability | YP_312213 | none | modify product export amount |
| AcrF | E. coli | Acriflavine resistance protein F | P24181 | none | modify product export amount |
| tll1619 | Thermosynechococcus elongatus [BP-1] | multidrug efflux transporter | NP_682409.1 | none | modify product export amount |
| tll0139 | Thermosynechococcus elongatus [BP-1] | multidrug efflux transporter | NP_680930.1 | none | modify product export amount |
| Fermentation | | | | | |
| replication checkpoint genes | | | | | increase output efficiency |
| umuD | Shigellasonnei Ss046 | DNA polymerase V, subunit | YP_310132 | 3.4.21.- | increase output efficiency |
| umuC | E. coli | DNA polymerase V, subunit | ABC42261 | 2.7.7.7 | increase output efficiency |
| pntA, pntB | Shigellaflexneri | NADH:NADPH transhydrogenase (alpha and beta subunits) | P07001, P0AB70 | 1.6.1.2 | increase output efficiency |
| Other | | | | | |
| fabK | Streptococcus pneumoniae | trans-2-enoyl-ACP reductase II | AAF98273 | 1.3.1.9 | Contributes to fatty acid biosynthesis |
| fabL | Bacillus licheniformis DSM 13 | enoyl-(acyl carrier protein) reductase | AAU39821 | 1.3.1.9 | Contributes to fatty acid biosynthesis |
| fabM | Streptococcus mutans | trans-2, cis-3-decenoyl-ACP isomerase | DAA05501 | 4.2.1.17 | Contributes to fatty acid biosynthesis |

FIG. 1 shows an exemplary pathway where an acyl thioester such as an acyl-ACP can be converted to a $C_{12}$ or $C_{16:1}$ fatty acid (FFA) as a precursor intermediate. In step 1 of FIG. 1, a thioesterase is employed to covert an acyl-ACP to a FFA. In certain embodiments, the gene encoding a thioesterase is tesA, 'tesA, tesB, fatB1, fatB2, fatB3, fatA1, or fatA (see also Table 1 that shows polypeptides that have the enzymatic activity of a thioesterase that can be used to catalyze this step, supra). In step 2, a CYP153A-reductase hybrid fusion polypeptide or variant thereof is used to generate ω-OH fatty acids (ω-OH FFAs) from fatty acids. Other bifunctional molecules can be produced downstream in the pathway, for example α,ω-diacids or other ω-OH fatty acid derivatives, depending on the enzymatic functionalities that are present in the pathway.

CYP153A-Reductase Hybrid Fusion Polypeptides

ω-Hydroxylases (or ω-oxygenases) include certain non-heme di-iron oxygenases (e.g., alkB from Pseudomonas putida GPo1) and certain heme-type P450 oxygenases (e.g., ω-hydroxylases such as cyp153A from Marinobacter aquaeolei). P450s are ubiquitously distributed enzymes, which possess high complexity and display a broad field of activity. They are proteins encoded by a superfamily of genes that convert a broad variety of substrates and catalyze a variety of chemical reactions. Cyp153A is a sub-family of soluble bacterial cytochrome P450s that hydroxylate hydrocarbon chains with high selectivity for the ω-position (van Beilen et al. (2006) Appl. Environ. Microbiol. 72:59-65). Members of the cyp153A family have been shown in vitro to selectively hydroxylate the ω-position of alkanes, fatty acids or fatty alcohols, for example cyp153A6 from Mycobacterium sp. HXN-1500 (Funhoff et al. (2006) J. Bacteriol. 188:5220-5227), cyp153A16 from Mycobacterium marinum and cyp153A from Polaromonas sp. JS666 (Scheps et al. (2011) Org. Biomol. Chem. 9:6727-6733) as well as cyp153A from Marinobacter aquaeoli (Honda-Malca et al. (2012) Chem. Commun. 48:5115-5117). Tables 2A and 2B below show examples of enzymes and redox partners that have ω-hydroxylase enzymatic activity that can be used to produce ω-OH fatty acids and ω-OH fatty acid derivatives.

TABLE 2A

Examples of ω-Hydroxylase Enzymatic Activity (P450) (EC 1.14.15.3)

| Gene Designation | Source Organism | Accession No. | Redox System | Hydroxylation Position |
|---|---|---|---|---|
| cyp153A (aciA) | Acinetobacter sp. OC4 | BAE78452 | operon with ferredoxin and ferredoxin reductase | ω-hydroxylase |
| cyp153A16 | Mycobacterium marinum M | YP_001851443 | operon with ferredoxin and ferredoxin reductase | ω-hydroxylase |
| cyp153A6 | Mycobacterium sp. HXN-1500 | AJ833989 | operon with ferredoxin and ferredoxin reductase | ω-hydroxylase |
| cyp153A | Marinobacter aquaeolei VT8 | YP_957888 | operon with ferredoxin and ferredoxin reductase | ω-hydroxylase |
| alkB | Pseudomonas putida GPo1 | CAB54050 | requires rubredoxin and rubredoxin reductase | ω-hydroxylase |
| alkB | Pseudomonas fluorescens CHA0 | CAB51045 | requires rubredoxin and rubredoxin reductase | ω-hydroxylase |
| alkM | Acinetobacter baylyi | YP_046098 | requires rubredoxin and rubredoxin reductase | ω-hydroxylase |
| alkB | Gordonia sp. SoGc | ADT82701 | requires rubredoxin and rubredoxin reductase | ω-hydroxylase |
| alkW1 | Dietzia sp. DQ12-45-1b | HQ850582 | c-terminal rubredoxin fusion, requires rubredoxin reductase | ω-hydroxylase |
| alkB | Pseudomonas putida GPo1 | CAB54050 | requires rubredoxin and rubredoxin reductase | ω-hydroxylase |
| alkB | Pseudomonas fluorescens CHA0 | CAB51045 | requires rubredoxin and rubredoxin reductase | ω-hydroxylase |

TABLE 2B

Examples of Redox Partners for ω-Hydroxylase Enzymatic Activity (P450) (EC 1.14.15.3)

| Designation/Name | Organism | Accession # |
|---|---|---|
| ferredoxin, ferredoxin reductase | Acinetobacter sp. OC4 | BAE78451, BAE78453 |
| ferredoxin, ferredoxin reductase | Mycobacterium marinum M | YP_001851444, YP_001851442 |
| ferredoxin, ferredoxin reductase | Marinobacter aquaeoli VT8 | YP_957887, YP_957889 |
| alkG, alkT | Pseudomonas putida GPo1 | CAB54052, CAB54063 |
| rubA, rubB | Acinetobacter baylyi ADP1 | CAA86925, CAA86926 |

As with all cytochrome P450s, Cyp153A ω-hydroxylases require electrons for their catalytic activity, which are provided via specific redox proteins such as ferredoxin and ferredoxin reductase. These are discrete proteins interacting with cyp153A. A self-sufficient hybrid (chimeric) cyp153A oxygenase (i.e., an oxygenase that does not require discrete ferredoxin and ferredoxin reductase proteins for activity) has previously been created by fusing cyp153A from *Alcanivorax borkumensis* SK2 (Kubota et al. (2005) *Biosci. Biotechnol. Biochem.* 69:2421-2430; Fujita et al. (2009) *Biosci. Biotechnol. Biochem.* 73:1825-1830) with the reductase domain from P450RhF, which includes flavin mononucleotide (FMN) and NADPH-binding sites and a [2FeS] ferredoxin center (Hunter et al. (2005) *FEBS Lett.* 579:2215-2220). P450RhF belongs to the class-I P450-fused PFOR (DeMot and Parret (2003) *Trends Microbiol.* 10: 502). This hybrid cyp153A-RedRhF fusion protein was shown in in vitro biotransformations to hydroxylate octane in the ω-position and also hydroxylate other compounds such as cyclohexane or butylbenzene. Other self-sufficient hybrid (chimeric) cyp153A oxygenases have been created by fusing cyp153A from *Marinobacter aquaeolei* with the reductase domains from P450RhF and P450-BM3 (Scheps et al. (2013) *Microb. Biotechnol.* 6:694-707). Examples of natural P450-Reductase fusion proteins are shown in Tables 2C and 2D below.

TABLE 2C

Examples of Self-Sufficient ω-1,ω-2,ω-3-Hydroxylase (EC 1.14.14.1) Fusion Proteins

| Gene Designation | Source Organism | Accession No. | Redox System | Hydroxylation Position |
|---|---|---|---|---|
| P450-BM3 (cyp102A1) | Bacillus megaterium | AAA87602 | fusion protein with reductase domain | ω-1,-2,-3 hydroxylation |
| yrhJ (cyp102A3) | Bacillus subtilis | NP_390594 | fusion protein with reductase domain | ω-1,-2,-3 hydroxylation |
| yrhJ (cyp102A7) | Bacillus licheniformis | AAU41718 | fusion protein with reductase domain | ω-1,-2,-3 hydroxylation |

TABLE 2D

Examples of Self-Sufficient Class-I P450-Fused PFOR Fusion Proteins

| Designation/Name | Organism | Accession # |
|---|---|---|
| P450RhF | Rhodococcus sp. NCIMB 9784 | AAM67416 |
| REQ_44300 | Rhodococcus equi 103S | YP_004009071 |
| HMPREF0018_01193 | Acinetobacter radioresistens SH164 | ZP_06072406 |
| BMAA1669 | Burkholderia mallei ATCC 23344 | YP_106239 |
| Rmet_4932 | Cupriavidus metallidurans CH34 | YP_587063 |
| H16_B1279 | Ralstonia eutropha H16 | YP_840799 |

Given their high selectivity towards the ω-position of hydrocarbon chains, the cyp153A family oxygenases appeared to be good examples of suitable candidates to produce α,ω-bifunctional fatty acid derivatives from a renewable carbon source. This would allow for the development of commercially feasible processes to produce these valuable compounds. Yet, as with other cytochrome P450s, the cyp153A family proteins have so far mostly been applied to in vitro experiments with purified enzymes or crude cell lysates or in resting cell biotransformations to which fatty acid derivatives or hydrocarbons are added exogenously (Kubota et al., Fujita et al., Honda-Malca et al., Scheps et al., supra). However, the hybrid fusion-employing in vitro procedures or resting cell biotransformations are not conducive to large scale and cost-efficient production of ω-hydroxy fatty acid derivatives. The widely accepted knowledge in the art is that many cytochrome P450s as well as alkB-type ω-hydroxylases are not easy to express functionally in recombinant microorganisms because the enzymes are often inactive and their chemistry has been difficult to elucidate. In fact, the only in vivo work using a renewable carbon source other than fatty acid-derivatives that has so far been attempted employed alkB ω-hydroxylase and achieved only low titer of ω-hydroxy fatty acid derivatives in a high cell density fermentation (WO2013/024114A2).

The present disclosure provides CYP153A-reductase hybrid fusion protein variants that are capable of efficiently producing ω-hydroxy fatty acid derivatives in vivo from a renewable carbon source. More specifically, a gene from *Marinobacter aquaeoli* coding for a hybrid fusion protein of the CYP153A (G307A) P450 catalytic domain, where an alanine (A) was substituted for a glycine (G) at position 307, was fused with a gene coding for the c-terminal FMN- and Fe/S-containing reductase domain of P450RhF from *Rhodococcus* sp. NCIMB9784 via a linker polypeptide. The resulting polypeptide is a CYP153A-RedRhF hybrid fusion polypeptide (SEQ ID NO: 6, see FIG. 3) with a corresponding nucleic acid sequence (SEQ ID NO: 5). When this CYP153A-reductase hybrid fusion protein was expressed in *E. coli* cells with a simple carbon source such as glucose fatty acid derivatives were efficiently converted to ω-hydroxy fatty acid derivatives (see Example 1). Other examples for suitable ω-hydroxylases (EC 1.14.15.3) and their redox partners that can be used to generate similar CYP153A-reductase hybrid fusion polypeptides are listed in Tables 2A and 2B (supra).

CYP153A-Reductase Hybrid Fusion Polypeptide Variants

The present disclosure identifies CYP153A-reductase hybrid fusion polypeptide variants that result in higher titer, yield and/or productivity of ω-hydroxylated fatty acid derivative compositions when compared to a CYP153A-reductase hybrid fusion polypeptide when expressed in host cells, in particular when compared to a CYP153A-reductase hybrid fusion polypeptide of, e.g., any of SEQ ID NO: 6, SEQ ID NO: 38, SEQ ID NO: 42, SEQ ID NO: 46, and SEQ ID NO: 98 expressed in a host cell, and more specifically when compared to the CYP153A-reductase hybrid fusion polypeptide of SEQ ID NO: 38 expressed in a host cell. In various embodiments, the present disclosure provides CYP153A-reductase hybrid fusion polypeptide variants that result in higher titer, yield and/or productivity of ω-hydroxylated fatty acid derivative compositions when compared to the CYP153A-reductase hybrid fusion polypeptide of, e.g., SEQ ID NO: 42, SEQ ID NO: 46 or SEQ ID NO: 98 expressed in a host cell. In non-limiting examples of the present disclosure (see Examples 1-7, infra) the hybrid CYP153A(G307A)-RedRhF fusion polypeptide (supra) was used as a template to efficiently engineer CYP153A-reductase hybrid fusion polypeptide variants to produce increased amounts of ω-OH fatty acids and ω-OH fatty acid derivatives. For example, such a CYP153A-reductase hybrid fusion polypeptide variant can efficiently convert compounds such as dodecanoic acid to 12-hydroxy dodecanoic acid in vivo from a simple carbon source such as glucose. Any simple carbon source, e.g., as derived from a renewable feedstock is suitable. It was shown that engineered CYP153A-reductase hybrid fusion polypeptide variants (i.e., illustrated via engineered CYP153A-RedRhF hybrid fusion polypeptide variants) can convert fatty acids in vivo to specific desirable compounds including ω-OH fatty acids when co-expressed with a thioesterase in a host cell such as *E. coli* by using a carbon source such as glucose from a renewable feedstock (see Examples, infra). By following the present disclosure, other hybrid fusion polypeptide variants can be engineered by linking a mutated gene such as a gene coding for a CYP153A catalytic domain to a mutated gene coding for a c-terminal reductase domain (see Tables 2A through 2D as well as FIG. 5, supra). Variations are encompassed herein, for example, mutating both genes (the P5450 catalytic domain and reductase domain) or mutating one gene (the P450 catalytic domain or reductase domain). Following these instructions, similar fusion protein variants can be created from other types of ω-hydroxylases.

Thus, the present disclosure relates to CYP153A-reductase hybrid fusion polypeptide variants that result in high titer, yield and/or productivity of ω-hydroxylated fatty acid derivative compositions when compared to CYP153A-reductase hybrid fusion polypeptides when expressed in host cells, in particular when compared to a CYP153A-reductase hybrid fusion polypeptide of, e.g., any of SEQ ID NO: 6, SEQ ID NO: 38, SEQ ID NO: 42, SEQ ID NO: 46 and SEQ ID NO: 98 expressed in host cells, and more specifically when compared to the CYP153A-reductase hybrid fusion polypeptide of SEQ ID NO: 38 expressed in host cells. In various embodiments, the present disclosure relates to CYP153A-reductase hybrid fusion polypeptide variants that result in high titer, yield and/or productivity of ω-hydroxylated fatty acid derivative compositions when compared to the CYP153A-reductase hybrid fusion polypeptide of, e.g., SEQ ID NO: 42, SEQ ID NO: 46, or SEQ ID NO: 98 expressed in host cells. The CYP153A-reductase hybrid fusion polypeptide variants have one or more mutations in the CYP153A domain or reductase domain or both. In one embodiment, the present disclosure provides a CYP153A-reductase hybrid fusion polypeptide variant having at least about 90%, 91%, 92%, 93%, 94%, 95%, 96%, 97%, 98% or 99% sequence identity to SEQ ID NO: 6 (see FIG. 3) and having one or more mutation at an amino acid position including position 27, 82, 141, 178, 231, 309, 407, 415, 516, 666 and/or 796, wherein the CYP153A-reductase hybrid fusion polypeptide variant catalyzes the conversion of a fatty acid to an ω-OH fatty acid. More specifically, the CYP153A-reductase hybrid fusion polypeptide variant has one or more of the following mutations, including R27L where arginine (R) is substituted with lysine (L); position R82D where arginine (R) is substituted with aspartic acid (D); position V141I where valine is substituted with isoleucine (I); position V141Q where valine (V) is substituted with glutamine (Q); position V141G where valine (V) is substituted with glycine (G); position V141M where valine (V) is substituted with methionine (M); position V141L where valine (V) is substituted with leucine (L); position V141T where valine (V) is substituted with threonine (T); position R178N where arginine (R) is substituted with asparagine (N); position A231T where alanine (A) is substituted with threonine (T); position N309R where asparagine (N) is substituted with arginine (R); position N407A where asparagine (N) is substituted with alanine (A); position V415R where valine (V) is substituted with arginine (R); position T516V where threonine (T) is substituted with valine (V); position P666A where proline (P) is substituted with alanine (A); position P666D where proline (P) is substituted with aspartic acid (D); and position A796V where alanine (A) is substituted with valine (V). Examples of CYP153A-reductase hybrid fusion polypeptide variants include SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28 or SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44 and SEQ ID NO: 46. In one embodiment, the CYP153A-reductase hybrid fusion polypeptide variant is a hybrid cyp153A-RedRhF-type fusion protein variant. In another embodiment, the CYP153A-reductase hybrid fusion polypeptide variant in a recombinant host cell results in a higher titer of an ω-OH fatty acid derivative or composition thereof as compared to the titer of an ω-OH fatty acid or composition thereof produced by expression of a CYP153A-reductase hybrid fusion polypeptide in a corresponding host cell. In another embodiment, the CYP153A-reductase hybrid fusion polypeptide variant has a mutation at amino acid position 141, including V141I and/or V141T. Herein, the expression of the CYP153A-reductase hybrid fusion polypeptide variant with mutations V141I or V141T in a recombinant host cell results in a higher titer of an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid, respectively, as compared to a titer of an ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acid produced by expression of a CYP153A-reductase hybrid fusion polypeptide. In one embodiment, the CYP153A-reductase hybrid fusion polypeptide variant has mutations V141I and A231T (SEQ ID NO: 32) and produces increased amounts of ω-OH $C_6$, $C_7$, $C_8$, $C_9$, $C_{10}$, $C_1$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids when expressed in a host cell with an enzymatic function of thioesterase. In another embodiment, the CYP153A-reductase hybrid fusion polypeptide variant has mutations R27L, R82D, V141M, R178N and N407A (SEQ ID NO: 34) and produces increased amounts of ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids when expressed in a host cell with an enzymatic function of thioesterase. In another embodiment, the CYP153A-reductase hybrid fusion polypeptide variant has mutation P666A (SEQ ID NO: 36) and produces increased amounts of ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids when expressed in a host cell with an enzymatic function of thioesterase. In another embodiment, the CYP153A-reductase hybrid fusion polypeptide variant has mutation A796V (SEQ ID NO: 38) in its reductase domain (see FIG. 5) and produces increased amounts of ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids when expressed in a host cell with an enzymatic function of thioesterase. In another embodiment, the CYP153A-reductase hybrid fusion polypeptide variant has mutations A796V, P666D and T516V (SEQ ID NO: 40) in its reductase domain and produces increased amounts of ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids when expressed in a host cell with an enzymatic function of thioesterase. In another embodiment, the CYP153A-reductase hybrid fusion polypeptide variant has mutations V141I and A231T in its catalytic domain and mutation A796V in its reductase domain (SEQ ID NO: 42) and produces increased amounts of ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids when expressed in a host cell with an enzymatic function of thioesterase. In another embodiment, the CYP153A-reductase hybrid fusion polypeptide variant has mutations R27L, R82D, V141M, R178N and N407A in its catalytic domain and mutation A796V in its reductase domain (SEQ ID NO: 44) and produces increased amounts of ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids when expressed in a host cell with an enzymatic function of thioesterase. In another embodiment, the CYP153A-reductase hybrid fusion polypeptide variant has mutations V141T and A231T in its catalytic domain and mutation A796V in its reductase domain (SEQ ID NO: 46) and produces increased amounts of ω-OH $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids when expressed in a host cell with an enzymatic function of thioesterase. In one embodiment, the variants of SEQ ID NO: 32, SEQ ID NO: 34, SEQ ID NO: 36, SEQ ID NO: 38, SEQ ID NO: 40, SEQ ID NO: 42, SEQ ID NO: 44 and SEQ ID NO: 46 produced increased amounts of ω-OH fatty acids or fatty acid derivatives when compared to SEQ ID NO: 6. In one embodiment, these ω-OH fatty acids are ω-OH $C_{8:0}$ fatty acids, ω-OH $C_{10:0}$ fatty acids, ω-OH $C_{12:0}$ fatty acids, ω-OH $C_{14:0}$ fatty acids, ω-OH $C_{16:0}$ fatty acids, ω-OH $C_{18:0}$ fatty acids, ω-OH $C_{20:0}$ fatty acids, ω-OH $C_{8:1}$ fatty acids, ω-OH $C_{10:1}$ fatty acids, ω-OH $C_{12:1}$ fatty acids, ω-OH $C_{14:1}$ fatty acids, ω-OH $C_{16:1}$ fatty acids, ω-OH $C_{18:1}$ fatty acids, ω-OH $C_{20:1}$ fatty acids, and the like.

The disclosure identifies CYP153A-reductase hybrid fusion-related polynucleotide and polypeptide variants. The CYP153A-reductase hybrid fusion polypeptide variants include SEQ ID NOS: 8, 10, 12, 14, 16, 18, 20, 22, 24, 26, 28, 30, 32, 34, 36, 38, 40, 42, 44 and 46. The CYP153A- reductase hybrid fusion nucleic acid variants (DNA sequences) include SEQ ID NOS: 7, 9, 11, 13, 15, 17, 19, 21, 23, 25, 27, 29, 31, 33, 35, 37, 39, 41, 43, 45 and 47. However, it will be recognized that absolute sequence identity to CYP153A-reductase hybrid fusion polynucleotide variants is not necessary. For example, changes in a particular polynucleotide sequence can be made and the encoded polypeptide screened for activity. Such changes typically include conservative mutations and silent mutations such as, for example, through codon optimization. Modified or mutated (i.e., mutant) polynucleotides and encoded variant polypeptides can be screened for a desired function, such as, an improved function compared to the wild type or template polypeptide, including but not limited to increased catalytic activity, increased stability, or decreased inhibition (e.g., decreased feedback inhibition), using methods known in the art. The disclosure identifies enzymatic activities involved in various steps (i.e., reactions) of the fatty acid biosynthetic pathways described herein according to Enzyme Classification (EC) number, and provides exemplary polypeptides (e.g., that function as specific enzymes and display specific enzyme activity) categorized by such EC numbers, and exemplary polynucleotides encoding such polypeptides. Such exemplary polypeptides and polynucleotides, which are identified herein by Sequence Identifier Numbers (SEQ ID NOs; supra), are useful for engineering fatty acid pathways in host cells such as the one shown in FIG. 1. It is to be understood, however, that polypeptides and polynucleotides described herein are exemplary and, thus, non-limiting. The sequences of homologues of exemplary polypeptides described herein are available to those of skill in the art using databases such as, for example, the Entrez databases provided by the National Center for Biotechnology Information (NCBI), the ExPasy databases provided by the Swiss Institute of Bioinformatics, the BRENDA database provided by the Technical University of Braunschweig, and the KEGG database provided by the Bioinformatics Center of Kyoto University and University of Tokyo, all which are available on the World Wide Web.

In one embodiment, a CYP153A-reductase hybrid fusion polypeptide variant for use in practicing the disclosure has at least about 90%, 91%, 92%, 93%, 94%, 95%, 96%, 97%, 98%, 99% or 100% sequence identity to SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28 or SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44 and SEQ ID NO: 46. In some embodiments the CYP153A-reductase hybrid fusion polypeptide variant is derived from a CYP153A (G307A) polypeptide from Marinobacter aquaeolei where an alanine (A) is substituted for a glycine (G) in the catalytic domain, and fused with a reductase domain of P450RhF from Rhodococcus sp. NCIMB9784 through a linker polypeptide. Cytochrome P450RhF is self-sufficient, displays a high degree of substrate promiscuity and catalyzes a wide range of functional groups. In other embodiments, a CYP153A-reductase hybrid fusion polypeptide variant for use in practicing the disclosure has at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or at least 99% sequence identity to SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28 or SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44 or SEQ ID NO: 46, and may also include one or more substitutions which results in useful characteristics and/or properties as described herein. In other embodiments, a CYP153A-reductase hybrid fusion polypeptide variant for use in practicing the disclosure has at least about 100%, 99%, 98%, 97%, 96%, 95%, 94%, 93%, 92%, 91% or 90% sequence identity to SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26, SEQ ID NO: 28 or SEQ ID NO: 30, SEQ ID NO: 32, SEQ ID NO: 34, SEQ ID NO: 36, SEQ ID NO: 38, SEQ ID NO: 40, SEQ ID NO: 42, SEQ ID NO: 44 or SEQ ID NO: 46. In still other embodiments, the P450 catalytic domain of the CYP153A-reductase hybrid fusion polypeptide variant is derived from an organism other than Marinobacter aquaeolei. Such other organisms include, but are not limited to, Acinetobacter sp., Mycobacterium marinum, Polaromonas sp., Alcanivorax borkumensis, Burkholderia fungorum, Caulobacter crescentus, Hyphomonas neptunium, Rhodopseudomonas palustris, Sphingomonas sp., Mycobacterium sp. In still other embodiments, the reductase domain of the CYP153A-reductase hybrid fusion polypeptide variant is derived from an organism other than Rhodococcus sp. Such other organisms include, but are not limited to, Rhodococcus equi, Acinetobacter radioresistens, Burkholderia mallei, Burkholderia mallei, Ralstonia eutropha, Cupriavidus metallidurans.

In a related embodiment, the disclosure includes a CYP153A-reductase hybrid fusion polynucleotide variant that has at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or at least 99% sequence identity to SEQ ID NO: 5, SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45 or SEQ ID NO: 47. In some embodiments the nucleic acid sequence encodes a CYP153A-reductase hybrid fusion polypeptide variant with one or more substitutions which results in improved characteristics and/or properties as described herein. In yet another related embodiment, a CYP153A-reductase hybrid fusion polypeptide variant for use in practicing the disclosure is encoded by a nucleotide sequence having at least about 100%, 99%, 98%, 97%, 96%, 95%, 94%, 93%, 92%, 91% or 90% sequence identity to SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45 or SEQ ID NO: 47. In another aspect, the disclosure relates to CYP153A-reductase hybrid fusion polypeptide variants that encompass an amino acid sequence encoded by a nucleic acid sequence that hybridizes under stringent conditions over substantially the entire length of a nucleic acid sequence corresponding to SEQ ID NO: 7, SEQ ID NO: 9, SEQ ID NO: 11, SEQ ID NO: 13, SEQ ID NO: 15, SEQ ID NO: 17, SEQ ID NO: 19, SEQ ID NO: 21, SEQ ID NO: 23, SEQ ID NO: 25, SEQ ID NO: 27, SEQ ID NO: 29, SEQ ID NO: 31, SEQ ID NO: 33, SEQ ID NO: 35, SEQ ID NO: 37, SEQ ID NO: 39, SEQ ID NO: 41, SEQ ID NO: 43, SEQ ID NO: 45 or SEQ ID NO: 47. In some embodiments the CYP153A-reductase hybrid fusion polypeptide variant is derived from *Marinobacter aquaeolei*. In other embodiments, the P450 hybrid fusion polypeptide is derived from *Acinetobacter* sp., *Mycobacterium marinum*, *Polaromonas* sp., *Alcanivorax borkumensis.*, *Burkholderia fungorum*, *Caulobacter crescentus*, *Hyphomonas neptunium*, *Rhodopseudomonas palustris*, *Sphingomonas* sp., and *Mycobacterium* sp.

Additional CYP153A-Reductase Hybrid Fusion Polypeptide Variants

The disclosure identifies additional CYP153A-reductase hybrid fusion-related polynucleotide and polypeptide variants, wherein a variant was used as a template (template variant). The CYP153A-reductase hybrid fusion polypeptide template variant (SEQ ID NO: 38) is based on the P540 CYP153A(G307A)-Red450RhF(A796V) fusion polypeptide and includes mutation G307A in the catalytic domain where a glycine (G) is replaced with an alanine (A) and mutation A796V in the reductase domain where an alanine (A) is replaced with a valine (V) wherein a linker polypeptide connects the catalytic domain to the reductase domain (see FIGS. 4 and 5). In some embodiments, a CYP153A polypeptide from *Marinobacter aquaeolei* is fused via a linker with a reductase domain of P450RhF from *Rhodococcus* sp. NCIMB9784. As noted above, cytochrome P450RhF is self-sufficient, displays a high degree of substrate promiscuity and catalyzes a wide range of functional groups. Mutation G307A in the catalytic domain and mutation A796V in the reductase domain are beneficial mutations that improve ω-hydroxylase activity of cyp153A (see SEQ ID NO: 38). A full saturation library of cyp153A-Red450RhF fusion proteins was built and screened for variants that showed improvements over P450 cyp153A (G307A)-Red450RhF(A796V) (SEQ ID NO: 38) (see Example 7). The resulting CYP153A-reductase hybrid fusion polypeptide variants are shown in the Examples (infra) as well as Sequence Tables B and C. These CYP153A-reductase hybrid fusion polypeptide variants produce an increased amount of ω-hydroxy fatty acids (ω-OH FFA titer) when compared to SEQ ID NO: 38 and include SEQ ID NOS: 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142 and 144. Similarly, these CYP153A-reductase hybrid fusion polypeptide variants produced an increased amount of ω-hydroxy fatty acids (ω-OH FFA titer) when compared to SEQ ID NO: 6 and include SEQ ID NOS: 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, and 164. These CYP153A-reductase hybrid fusion polypeptide variants may produce increased amounts of ω-OH fatty acids including $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids and/or fatty acid derivatives.

Mutations Q12W, R27L, K119R, S140N, S157R, V159M, S233L and A244R (in addition to mutation G307A) in the catalytic domain and mutation A796V in the reductase domain are beneficial mutations that further improved ω-hydroxylase activity of cyp153A (see SEQ ID NO: 98 and Example 8). A full saturation library of cyp153A-Red450RhF fusion proteins was built and screened for variants that showed improvements over SEQ ID NO: 98 (see Example 11). The resulting CYP153A-reductase hybrid fusion polypeptide variants are shown in the Examples (infra) as well as Sequence Table C (infra). These CYP153A-reductase hybrid fusion polypeptide variants produced an increased amount of ω-hydroxy fatty acids (ω-OH FFA titer) when compared to SEQ ID NO: 98 and include SEQ ID NOS: 146, 148, 150, 152, 154, 156, 158, 160, 162 and 164. Similarly, these CYP153A-reductase hybrid fusion polypeptide variants produced an increased amount of ω-hydroxy fatty acids (ω-OH FFA titer) when compared to SEQ ID NO: 6 as well as SEQ ID NO: 38 and include SEQ ID NOS: 146, 148, 150, 152, 154, 156, 158, 160, 162 and 164. These CYP153A-reductase hybrid fusion polypeptide variants may produce increased amounts of 0-OH fatty acids including $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{8:1}$, $C_{9:1}$, $C_{10:1}$, $C_{11:1}$, $C_{12:1}$, $C_{13:1}$, $C_{14:1}$, $C_{15:1}$, $C_{16:1}$, $C_{17:1}$, $C_{18:1}$, $C_{19:1}$ and/or $C_{20:1}$ fatty acids and/or fatty acid derivatives.

The CYP153A-reductase hybrid fusion nucleic acid variants (DNA sequences) include SEQ ID NOS: 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161 and 163. However, it will be recognized that absolute sequence identity to CYP153A-reductase hybrid fusion polynucleotide variants is not necessary. For example, changes in a particular polynucleotide sequence can be made and the encoded polypeptide screened for activity. Such changes typically include conservative mutations and silent mutations such as, for example, through codon optimization. Modified or mutated (i.e., mutant) polynucleotides and encoded variant polypeptides can be screened for a desired function, such as, an improved function compared to the wild type or template polypeptide, including but not limited to increased catalytic activity, increased stability, or decreased inhibition (e.g., decreased feedback inhibition), using methods known in the art. The disclosure identifies enzymatic activities involved in various steps (i.e., reactions) of the fatty acid biosynthetic pathways described herein according to Enzyme Classification (EC) number, and provides exemplary polypeptides (e.g., that function as specific enzymes and display specific enzyme activity) categorized by such EC numbers, and exemplary polynucleotides encoding such polypeptides. Such exemplary polypeptides and polynucleotides, which are identified herein by Sequence Identifier Numbers (SEQ ID NOs; supra), are useful for engineering fatty acid pathways in host cells such as the one shown in FIG. 1. It is to be understood, however, that polypeptides and polynucleotides described herein are exemplary and, thus, non-limiting. The sequences of homologues of exemplary polypeptides described herein are available to those of skill in the art using databases such as, for example, the Entrez databases provided by the National Center for Biotechnology Information (NCBI), the ExPasy databases provided by the Swiss Institute of Bioinformatics, the BRENDA database provided by the Technical University of Braunschweig, and the KEGG database provided by the Bioinformatics Center of Kyoto University and University of Tokyo, all which are available on the World Wide Web.

In various embodiments, a CYP153A-reductase hybrid fusion polypeptide variant of the present disclosure has at least about 80%, 81%, 82%, 83%, 84%, 85%, 86%, 87%, 88%, or 89% sequence identity to the amino acid sequence of any of SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO:

128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162 and SEQ ID NO: 164, wherein said CYP153A-reductase hybrid fusion polypeptide variant catalyzes the conversion of a fatty acid to an omega-hydroxylated fatty acid. Preferably, the said CYP153A-reductase hybrid fusion polypeptide variant provides upon expression in a recombinant host cell for a higher titer of an omega-hydroxylated fatty acid as compared to the titer of an omega-hydroxylated fatty acid produced by expression of the CYP153A-reductase hybrid fusion polypeptide of SEQ ID NO: 6 or SEQ ID NO: 38 in a corresponding host cell. In various embodiments, a CYP153A-reductase hybrid fusion polypeptide variant of the present disclosure has at least about 90%, 91%, 92%, 93%, 94%, 95%, 96%, 97%, 98%, 99% or 100% sequence identity to the amino acid sequence of any of SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162 and SEQ ID NO: 164, wherein said CYP153A-reductase hybrid fusion polypeptide variant catalyzes the conversion of a fatty acid to an omega-hydroxylated fatty acid. Preferably, the said CYP153A-reductase hybrid fusion polypeptide variant provides upon expression in a recombinant host cell for a higher titer of an omega-hydroxylated fatty acid as compared to the titer of an omega-hydroxylated fatty acid produced by expression of the CYP153A-reductase hybrid fusion polypeptide of SEQ ID NO: 6 or SEQ ID NO: 38 in a corresponding host cell. In some embodiments the CYP153A-reductase hybrid fusion polypeptide variant is derived from a CYP153A (G307A) polypeptide from *Marinobacter aquaeolei* where a glycine (G) is replaced with an alanine (A), and fused with a reductase domain of P450RhF from *Rhodococcus* sp. NCIMB9784, and includes an additional mutation of A796V where an alanine (A) is replaced with a valine (V). In other embodiments, a CYP153A-reductase hybrid fusion polypeptide variant for use in practicing the disclosure has at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or at least 99% sequence identity to SEQ ID NO: 38, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68 or SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, SEQ ID NO: 96, SEQ ID NO: 98, SEQ ID NO: 100, SEQ ID NO: 102, SEQ ID NO: 104, SEQ ID NO: 106, SEQ ID NO: 108, SEQ ID NO: 110, SEQ ID NO: 112, SEQ ID NO: 114, SEQ ID NO: 116, SEQ ID NO: 118, SEQ ID NO: 120, SEQ ID NO: 122, SEQ ID NO: 124, SEQ ID NO: 126, SEQ ID NO: 128, SEQ ID NO: 130, SEQ ID NO: 132, SEQ ID NO: 134, SEQ ID NO: 136, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162 and SEQ ID NO: 164, and may also include one or more substitutions which results in useful characteristics and/or properties as described herein. In other embodiments, a CYP153A-reductase hybrid fusion polypeptide variant for use in practicing the disclosure has at least about 100%, 99%, 98%, 97%, 96%, 95%, 94%, 93%, 92%, 91% or 90% sequence identity to SEQ ID NO: 38, SEQ ID NO: 48, SEQ ID NO: 50, SEQ ID NO: 52, SEQ ID NO: 54, SEQ ID NO: 56, SEQ ID NO: 58, SEQ ID NO: 60, SEQ ID NO: 62, SEQ ID NO: 64, SEQ ID NO: 66, SEQ ID NO: 68 or SEQ ID NO: 70, SEQ ID NO: 72, SEQ ID NO: 74, SEQ ID NO: 76, SEQ ID NO: 78, SEQ ID NO: 80, SEQ ID NO: 82, SEQ ID NO: 84, SEQ ID NO: 86, SEQ ID NO: 88, SEQ ID NO: 90, SEQ ID NO: 92, SEQ ID NO: 94, or SEQ ID NO: 96. In still other embodiments, the P450 catalytic domain of the CYP153A-reductase hybrid fusion polypeptide variant is derived from an organism other than *Marinobacter aquaeolei*. Such other organisms include, but are not limited to, *Acinetobacter* sp., *Mycobacterium marinum*, *Polaromonas* sp., *Alcanivorax borkumensis*, *Burkholderia fungorum*, *Caulobacter crescentus*, *Hyphomonas neptunium*, *Rhodopseudomonas palustris*, *Sphingomonas* sp., *Mycobacterium* sp. In still other embodiments, the reductase domain of the CYP153A-reductase hybrid fusion polypeptide variant is derived from an organism other than *Rhodococcus* sp. Such other organisms include, but are not limited to, *Rhodococcus equi*, *Acinetobacter radioresistens*, *Burkholderia mallei*, *Burkholderia mallei*, *Ralstonia eutropha*, *Cupriavidus metallidurans*.

In a related embodiment, the disclosure includes a CYP153A-reductase hybrid fusion polynucleotide variant that has at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or at least 99% sequence identity to the nucleic acid sequence of any of SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161 and SEQ ID NO: 163, wherein a CYP153A-reductase hybrid fusion polypeptide variant encoded by said CYP153A-reductase hybrid fusion polynucleotide variant catalyzes the conversion of a fatty acid to an omega-hydroxylated fatty acid. Preferably, the said CYP153A-reductase hybrid fusion polypeptide variant encoded by said CYP153A-reductase hybrid fusion polynucleotide variant provides upon expression in a recombinant host cell for a higher titer of an omega-hydroxylated fatty acid as compared to the titer of an omega-hydroxylated fatty acid produced by expression of the CYP153A-reductase hybrid fusion polypeptide of SEQ ID NO: 6 or SEQ ID NO: 38 in a corresponding host cell. In some embodiments the nucleic acid sequence encodes a CYP153A-reductase hybrid fusion polypeptide variant with one or more substitutions which results in improved characteristics and/or properties as described herein. In yet another related embodiment, a CYP153A-reductase hybrid fusion polypeptide variant of the present disclosure is encoded by a nucleotide sequence having at least about 100%, 99%, 98%, 97%, 96%, 95%, 94%, 93%, 92%, 91% or 90% sequence identity to the nucleotide sequence of any of SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161 and SEQ ID NO: 163. In another aspect, the disclosure relates to CYP153A-reductase hybrid fusion polypeptide variants that encompass an amino acid sequence encoded by a nucleic acid sequence that hybridizes under stringent conditions over substantially the entire length of a nucleic acid sequence corresponding to any of SEQ ID NO: 97, SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119, SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141, SEQ ID NO: 143, SEQ ID NO: 145, SEQ ID NO: 147, SEQ ID NO: 149, SEQ ID NO: 151, SEQ ID NO: 153, SEQ ID NO: 155, SEQ ID NO: 157, SEQ ID NO: 159, SEQ ID NO: 161 and SEQ ID NO: 163. In some embodiments the CYP153A-reductase hybrid fusion polypeptide variant is derived from a *Marinobacter aquaeolei* species. In other embodiments, the P450 hybrid fusion polypeptide is derived from *Acinetobacter* sp., *Mycobacterium marinum*, *Polaromonas* sp., *Alcanivorax borkumensis.*, *Burkholderia fungorum*, *Caulobacter crescentus*, *Hyphomonas neptunium*, *Rhodopseudomonas palustris*, *Sphingomonas* sp., and *Mycobacterium* sp.

Sequences

The variants shown in Sequence Table A below are based on hybrid cytochrome P450 cyp153A16(G307A)-RedRhF fusion protein.

SEQUENCE TABLE A with Variants based on Hybrid Cytochrome P450 Cyp153A16(G307A)-RedRhF Fusion Protein as shown in SEQ ID NO: 6

| Description | Sequence Identifying Number (SEQ ID NO) |
|---|---|
| P450 Cyp153A *Marinobacter aquaeolei* VT8 wild type sequence (DNA) | 1 |
| P450 Cyp153A *Marinobacter aquaeolei* VT8 wild type sequence (protein) | 2 |
| Cytochrome P450 Cyp153A16(G307A) from *Marinobacter aquaeolei*, YP_957888 (DNA) | 3 |
| Cytochrome P450 Cyp153A16(G307A) from *Marinobacter aquaeolei*, YP_957888 (protein) | 4 |
| Hybrid Cytochrome P450 Cyp153A16(G307A)-RedRhF Fusion Protein (Template) (DNA) | 5 |
| Hybrid Cytochrome P450 Cyp153A16(G307A)-RedRhF Fusion Protein (Template) (protein) | 6 |
| Hybrid Cytochrome P450 Cyp153A16(G307A)-RedRhF Fusion Protein Variant R27L (DNA) | 7 |
| Hybrid Cytochrome P450 Cyp153A16(G307A)-RedRhF Fusion Protein Variant R27L (protein) | 8 |
| Hybrid Cytochrome P450 Cyp153A16(G307A)-RedRhF Fusion Protein Variant R82D (DNA) | 9 |
| Hybrid Cytochrome P450 Cyp153A16(G307A)-RedRhF Fusion Protein Variant R82D (protein) | 10 |
| Hybrid Cytochrome P450 Cyp153A16(G307A)-RedRhF Fusion Protein Variant V141I (DNA) | 11 |
| Hybrid Cytochrome P450 Cyp153A16(G307A)-RedRhF Fusion Protein Variant V141I (protein) | 12 |
| Hybrid Cytochrome P450 Cyp153A16(G307A)-RedRhF Fusion Protein Variant V141Q (DNA) | 13 |
| Hybrid Cytochrome P450 Cyp153A16(G307A)-RedRhF Fusion Protein Variant V141Q (protein) | 14 |
| Hybrid Cytochrome P450 Cyp153A16(G307A)-RedRhF Fusion Protein Variant V141G (DNA) | 15 |
| Hybrid Cytochrome P450 Cyp153A16(G307A)-RedRhF Fusion Protein Variant V141G (protein) | 16 |
| Hybrid Cytochrome P450 Cyp153A16(G307A)-RedRhF Fusion Protein Variant V141M (DNA) | 17 |
| Hybrid Cytochrome P450 Cyp153A16(G307A)-RedRhF Fusion Protein Variant V141M (protein) | 18 |
| Hybrid Cytochrome P450 Cyp153A16(G307A)-RedRhF Fusion Protein Variant V141L (DNA) | 19 |
| Hybrid Cytochrome P450 Cyp153A16(G307A)-RedRhF Fusion Protein Variant V141L (protein) | 20 |
| Hybrid Cytochrome P450 Cyp153A16(G307A)-RedRhF Fusion Protein Variant V141T (DNA) | 21 |
| Hybrid Cytochrome P450 Cyp153A16(G307A)-RedRhF Fusion Protein Variant V141T (protein | 22 |
| Hybrid Cytochrome P450 Cyp153A16(G307A)-RedRhF Fusion Protein Variant R178N (DNA) | 23 |
| Hybrid Cytochrome P450 Cyp153A16(G307A)-RedRhF Fusion Protein Variant R178N (protein) | 24 |
| Hybrid Cytochrome P450 Cyp153A16(G307A)-RedRhF Fusion Protein Variant N309R (DNA) | 25 |

SEQUENCE TABLE A with Variants based on Hybrid Cytochrome P450 Cyp153A16(G307A)-RedRhF Fusion Protein as shown in SEQ ID NO: 6

| Description | Sequence Identifying Number (SEQ ID NO) |
|---|---|
| Hybrid Cytochrome P450 Cyp153A16(G307A)-RedRhF Fusion Protein Variant N309R (protein) | 26 |
| Hybrid Cytochrome P450 Cyp153A16(G307A)-RedRhF Fusion Protein Variant N407A (DNA) | 27 |
| Hybrid Cytochrome P450 Cyp153A16(G307A)-RedRhF Fusion Protein Variant N407A (protein) | 28 |
| Hybrid Cytochrome P450 Cyp153A16(G307A)-RedRhF Fusion Protein Variant V415R (DNA) | 29 |
| Hybrid Cytochrome P450 Cyp153A16(G307A)-RedRhF Fusion Protein Variant V415R (protein) | 30 |
| Hybrid Cytochrome P450 Cyp153A16(G307A)-RedRhF Fusion Protein Variant V141I and A231T (DNA) | 31 |
| Hybrid Cytochrome P450 Cyp153A16(G307A)-RedRhF Fusion Protein Variant V141I and A231T (protein) | 32 |
| Hybrid Cytochrome P450 Cyp153A16(G307A)-RedRhF Fusion Protein Variant R27L, R82D, V141M, R178N and N407A (DNA) | 33 |
| Hybrid Cytochrome P450 Cyp153A16(G307A)-RedRhF Fusion Protein Variant R27L, R82D, V141M, R178N and N407A (protein) | 34 |
| Hybrid Cytochrome P450 Cyp153A16(G307A)-RedRhF Fusion Protein Variant P666A (DNA) | 35 |
| Hybrid Cytochrome P450 Cyp153A16(G307A)-RedRhF Fusion Protein Variant P666A (protein) | 36 |
| Hybrid Cytochrome P450 Cyp153A16(G307A)-RedRhF Fusion Protein Variant A796V (DNA) | 37 |
| Hybrid Cytochrome P450 Cyp153A16(G307A)-RedRhF Fusion Protein Variant A796V (protein) | 38 |
| Hybrid Cytochrome P450 Cyp153A16(G307A)-RedRhF Fusion Protein Variant T516V, P666D and A796V (DNA) | 39 |
| Hybrid Cytochrome P450 Cyp153A16(G307A)-RedRhF Fusion Protein Variant T516V, P666D and A796V (protein) | 40 |
| Hybrid Cytochrome P450 Cyp153A16(G307A)-RedRhF Fusion Protein Variant V141I, A231T and A796V (DNA) | 41 |
| Hybrid Cytochrome P450 Cyp153A16(G307A)-RedRhF Fusion Protein Variant V141I, A231T and A796V (protein) | 42 |
| Hybrid Cytochrome P450 Cyp153A16(G307A)-RedRhF Fusion Protein Variant R27L, R82D, V141M, R178N, N407A and A796V (DNA) | 43 |
| Hybrid Cytochrome P450 Cyp153A16(G307A)-RedRhF Fusion Protein Variant R27L, R82D, V141M, R178N, N407A and A796V (protein) | 44 |
| Hybrid Cytochrome P450 Cyp153A16(G307A)-RedRhF Fusion Protein Variant V141T, A231T and A796V (DNA) | 45 |
| Hybrid Cytochrome P450 Cyp153A16(G307A)-RedRhF Fusion Protein Variant V141T, A231T and A796V (protein) | 46 |

The variants shown in Sequence Table B below are based on hybrid cytochrome P450 cyp153A(G307A)-Red450RhF (A796V) fusion protein.

SEQUENCE TABLE B with Variants based on Hybrid Cytochrome P450 cyp153A(G307A)-Red450RhF(A796V) Fusion Protein as shown in SEQ ID NO: 38

| Description | Sequence Identifying Number (SEQ ID NO) |
|---|---|
| Hybrid Cytochrome P450 Cyp153A(G307A)-Red450RhF(A796V) Fusion Protein (Template) (DNA) | 37 |
| Hybrid Cytochrome P450 Cyp153A(G307A)-Red450RhF(A796V) Fusion Protein (Template) (protein) | 38 |
| Hybrid Cytochrome P450 Cyp153A16(G307A)-RedRhF(A796V) Fusion Protein Variant D747N (DNA) | 47 |
| Hybrid Cytochrome P450 Cyp153A16(G307A)-RedRhF(A796V) Fusion Protein Variant D747N (protein) | 48 |
| Hybrid Cytochrome P450 Cyp153A16(G307A)-RedRhF(A796V) Fusion Protein Variant Q12W (DNA) | 49 |
| Hybrid Cytochrome P450 Cyp153A16(G307A)-RedRhF(A796V) Fusion Protein Variant Q12W (protein) | 50 |
| Hybrid Cytochrome P450 Cyp153A16(G307A)-RedRhF(A796V) Fusion Protein Variant P327D (DNA) | 51 |
| Hybrid Cytochrome P450 Cyp153A16(G307A)-RedRhF(A796V) Fusion Protein Variant P327D (protein) | 52 |

SEQUENCE TABLE B with Variants based on Hybrid Cytochrome P450 cyp153A(G307A)-Red450RhF(A796V) Fusion Protein as shown in SEQ ID NO: 38

| Description | Sequence Identifying Number (SEQ ID NO) |
|---|---|
| Hybrid Cytochrome P450 Cyp153A16(G307A)-RedRhF(A796V) Fusion Protein Variant R14F (DNA) | 53 |
| Hybrid Cytochrome P450 Cyp153A16(G307A)-RedRhF(A796V) Fusion Protein Variant R14F (protein) | 54 |
| Hybrid Cytochrome P450 Cyp153A16(G307A)-RedRhF(A796V) Fusion Protein Variant N61L (DNA) | 55 |
| Hybrid Cytochrome P450 Cyp153A16(G307A)-RedRhF(A796V) Fusion Protein Variant N61L (protein) | 56 |
| Hybrid Cytochrome P450 Cyp153A16(G307A)-RedRhF(A796V) Fusion Protein Variant Q28M (DNA) | 57 |
| Hybrid Cytochrome P450 Cyp153A16(G307A)-RedRhF(A796V) Fusion Protein Variant Q28M (protein) | 58 |
| Hybrid Cytochrome P450 Cyp153A16(G307A)-RedRhF(A796V) Fusion Protein Variant S13K (DNA) | 59 |
| Hybrid Cytochrome P450 Cyp153A16(G307A)-RedRhF(A796V) Fusion Protein Variant S13K (protein) | 60 |
| Hybrid Cytochrome P450 Cyp153A16(G307A)-RedRhF(A796V) Fusion Protein Variant V771F (DNA) | 61 |
| Hybrid Cytochrome P450 Cyp153A16(G307A)-RedRhF(A796V) Fusion Protein Variant V771F (protein) | 62 |
| Hybrid Cytochrome P450 Cyp153A16(G307A)-RedRhF(A796V) Fusion Protein Variant Q12T (DNA) | 63 |
| Hybrid Cytochrome P450 Cyp153A16(G307A)-RedRhF(A796V) Fusion Protein Variant Q12T (protein) | 64 |
| Hybrid Cytochrome P450 Cyp153A16(G307A)-RedRhF(A796V) Fusion Protein Variant K119R (DNA) | 65 |
| Hybrid Cytochrome P450 Cyp153A16(G307A)-RedRhF(A796V) Fusion Protein Variant K119R (protein) | 66 |
| Hybrid Cytochrome P450 Cyp153A16(G307A)-RedRhF(A796V) Fusion Protein Variant D10Y (DNA) | 67 |
| Hybrid Cytochrome P450 Cyp153A16(G307A)-RedRhF(A796V) Fusion Protein Variant D10Y (protein) | 68 |
| Hybrid Cytochrome P450 Cyp153A16(G307A)-RedRhF(A796V) Fusion Protein Variant Q12R (DNA) | 69 |
| Hybrid Cytochrome P450 Cyp153A16(G307A)-RedRhF(A796V) Fusion Protein Variant Q12R (protein) | 70 |
| Hybrid Cytochrome P450 Cyp153A16(G307A)-RedRhF(A796V) Fusion Protein Variant I11L (DNA) | 71 |
| Hybrid Cytochrome P450 Cyp153A16(G307A)-RedRhF(A796V) Fusion Protein Variant I11L (protein) | 72 |
| Hybrid Cytochrome P450 Cyp153A16(G307A)-RedRhF(A796V) Fusion Protein Variant Q28T (DNA) | 73 |
| Hybrid Cytochrome P450 Cyp153A16(G307A)-RedRhF(A796V) Fusion Protein Variant Q28T (protein) | 74 |
| Hybrid Cytochrome P450 Cyp153A16(G307A)-RedRhF(A796V) Fusion Protein Variant A231Y (DNA) | 75 |
| Hybrid Cytochrome P450 Cyp153A16(G307A)-RedRhF(A796V) Fusion Protein Variant A231Y (protein) | 76 |
| Hybrid Cytochrome P450 Cyp153A16(G307A)-RedRhF(A796V) Fusion Protein Variant P745R (DNA) | 77 |
| Hybrid Cytochrome P450 Cyp153A16(G307A)-RedRhF(A796V) Fusion Protein Variant P745R (protein) | 78 |
| Hybrid Cytochrome P450 Cyp153A16(G307A)-RedRhF(A796V) Fusion Protein Variant D9N (DNA) | 79 |
| Hybrid Cytochrome P450 Cyp153A16(G307A)-RedRhF(A796V) Fusion Protein Variant D9N (protein) | 80 |
| Hybrid Cytochrome P450 Cyp153A16(G307A)-RedRhF(A796V) Fusion Protein Variant T770G (DNA) | 81 |
| Hybrid Cytochrome P450 Cyp153A16(G307A)-RedRhF(A796V) Fusion Protein Variant T770G (protein) | 82 |
| Hybrid Cytochrome P450 Cyp153A16(G307A)-RedRhF(A796V) Fusion Protein Variant Y413R (DNA) | 83 |
| Hybrid Cytochrome P450 Cyp153A16(G307A)-RedRhF(A796V) Fusion Protein Variant Y413R (protein) | 84 |
| Hybrid Cytochrome P450 Cyp153A16(G307A)-RedRhF(A796V) Fusion Protein Variant M784I (DNA) | 85 |
| Hybrid Cytochrome P450 Cyp153A16(G307A)-RedRhF(A796V) Fusion Protein Variant M784I (protein) | 86 |
| Hybrid Cytochrome P450 Cyp153A16(G307A)-RedRhF(A796V) Fusion Protein Variant D9K (DNA) | 87 |
| Hybrid Cytochrome P450 Cyp153A16(G307A)-RedRhF(A796V) Fusion Protein Variant D9K (protein) | 88 |

SEQUENCE TABLE B with Variants based on Hybrid Cytochrome P450 cyp153A(G307A)-
Red450RhF(A796V) Fusion Protein as shown in SEQ ID NO: 38

| Description | Sequence Identifying Number (SEQ ID NO) |
|---|---|
| Hybrid Cytochrome P450 Cyp153A16(G307A)-RedRhF(A796V) Fusion Protein Variant E749L (DNA) | 89 |
| Hybrid Cytochrome P450 Cyp153A16(G307A)-RedRhF(A796V) Fusion Protein Variant E749L (protein) | 90 |
| Hybrid Cytochrome P450 Cyp153A16(G307A)-RedRhF(A796V) Fusion Protein Variant S233L (DNA) | 91 |
| Hybrid Cytochrome P450 Cyp153A16(G307A)-RedRhF(A796V) Fusion Protein Variant S233L (protein) | 92 |
| Hybrid Cytochrome P450 Cyp153A16(G307A)-RedRhF(A796V) Fusion Protein Variant E757A (DNA) | 93 |
| Hybrid Cytochrome P450 Cyp153A16(G307A)-RedRhF(A796V) Fusion Protein Variant E757A (protein) | 94 |
| Hybrid Cytochrome P450 Cyp153A16(G307A)-RedRhF(A796V) Fusion Protein Variant L703G (DNA) | 95 |
| Hybrid Cytochrome P450 Cyp153A16(G307A)-RedRhF(A796V) Fusion Protein Variant L703G (protein) | 96 |
| Hybrid Cytochrome P450 Cyp153A16(G307A)-RedRhF(A796V) Fusion Protein Variant Q12W, R27L, K119R, S140N, S157R, V159M, S233L, A244R (DNA) | 97 |
| Hybrid Cytochrome P450 Cyp153A16(G307A)-RedRhF(A796V) Fusion Protein Variant Q12W, R27L, K119R, S140N, S157R, V159M, S233L, A244R (protein) | 98 |
| Hybrid Cytochrome P450 Cyp153A16(G307A)-RedRhF(A796V) Fusion Protein Variant Q12R, Q28M, N61L, K119R, A231V, N309S, Y413R, I480G (DNA) | 99 |
| Hybrid Cytochrome P450 Cyp153A16(G307A)-RedRhF(A796V) Fusion Protein Variant Q12R, Q28M, N61L, K119R, A231V, N309S, Y413R, I480G (protein) | 100 |
| Hybrid Cytochrome P450 Cyp153A16(G307A)-RedRhF(A796V) Fusion Protein Variant Q12R, K119R, A231V, I480G (DNA) | 101 |
| Hybrid Cytochrome P450 Cyp153A16(G307A)-RedRhF(A796V) Fusion Protein Variant Q12R, K119R, A231V, I480G (protein) | 102 |
| Hybrid Cytochrome P450 Cyp153A16(G307A)-RedRhF(A796V) Fusion Protein Variant Q12T, Q28M, R77Q, K119R, V141T, A231W, N407G (DNA) | 103 |
| Hybrid Cytochrome P450 Cyp153A16(G307A)-RedRhF(A796V) Fusion Protein Variant Q12T, Q28M, R77Q, K119R, V141T, A231W, N407G (protein) | 104 |
| Hybrid Cytochrome P450 Cyp153A16(G307A)-RedRhF(A796V) Fusion Protein Variant Q12R, Q28M, N61L, V141T, A231Y, N407G (DNA) | 105 |
| Hybrid Cytochrome P450 Cyp153A16(G307A)-RedRhF(A796V) Fusion Protein Variant Q12R, Q28M, N61L, V141T, A231Y, N407G (protein) | 106 |
| Hybrid Cytochrome P450 Cyp153A16(G307A)-RedRhF(A796V) Fusion Protein Variant Q12W, Q28M, K119R, A231Y, A244R (DNA) | 107 |
| Hybrid Cytochrome P450 Cyp153A16(G307A)-RedRhF(A796V) Fusion Protein Variant Q12W, Q28M, K119R, A231Y, A244R (protein) | 108 |
| Hybrid Cytochrome P450 Cyp153A16(G307A)-RedRhF(A796V) Fusion Protein Variant Q12W, Q28T, N407G, I480G (DNA) | 109 |
| Hybrid Cytochrome P450 Cyp153A16(G307A)-RedRhF(A796V) Fusion Protein Variant Q12W, Q28T, N407G, I480G (protein) | 110 |
| Hybrid Cytochrome P450 Cyp153A16(G307A)-RedRhF(A796V) Fusion Protein Variant Q12R, V141T, A231Y, Y413R, G481I (DNA) | 111 |
| Hybrid Cytochrome P450 Cyp153A16(G307A)-RedRhF(A796V) Fusion Protein Variant Q12R, V141T, A231Y, Y413R, G481I (protein) | 112 |
| Hybrid Cytochrome P450 Cyp153A16(G307A)-RedRhF(A796V) Fusion Protein Variant Q12T, Q28M, F111A, A231V, N407G (DNA) | 113 |
| Hybrid Cytochrome P450 Cyp153A16(G307A)-RedRhF(A796V) Fusion Protein Variant Q12T, Q28M, F111A, A231V, N407G (protein) | 114 |
| Hybrid Cytochrome P450 Cyp153A16(G307A)-RedRhF(A796V) Fusion Protein Variant Q12T, Q28M, N61L, S140N, P149R (DNA) | 115 |
| Hybrid Cytochrome P450 Cyp153A16(G307A)-RedRhF(A796V) Fusion Protein Variant Q12T, Q28M, N61L, S140N, P149R (protein) | 116 |
| Hybrid Cytochrome P450 Cyp153A16(G307A)-RedRhF(A796V) Fusion Protein Variant Q12W, Q28T, R77Q, K119R, V159M, A231Y, R254G, N407G, I480G (DNA) | 117 |
| Hybrid Cytochrome P450 Cyp153A16(G307A)-RedRhF(A796V) Fusion Protein Variant Q12W, Q28T, R77Q, K119R, V159M, A231Y, R254G, N407G, I480G (protein) | 118 |
| Hybrid Cytochrome P450 Cyp153A16(G307A)-RedRhF(A796V) Fusion Protein Variant Q12W, Q28T, R254G, N309S, N407G, V451M (DNA) | 119 |
| Hybrid Cytochrome P450 Cyp153A16(G307A)-RedRhF(A796V) Fusion Protein Variant Q12W, Q28T, R254G, N309S, N407G, V451M (protein) | 120 |

SEQUENCE TABLE B with Variants based on Hybrid Cytochrome P450 cyp153A(G307A)-Red450RhF(A796V) Fusion Protein as shown in SEQ ID NO: 38

| Description | Sequence Identifying Number (SEQ ID NO) |
|---|---|
| Hybrid Cytochrome P450 Cyp153A16(G307A)-RedRhF(A796V) Fusion Protein Variant Q12W, Q28T, R254G, N309S, N407G, I480G (DNA) | 121 |
| Hybrid Cytochrome P450 Cyp153A16(G307A)-RedRhF(A796V) Fusion Protein Variant Q12W, Q28T, R254G, N309S, N407G, I480G (protein) | 122 |
| Hybrid Cytochrome P450 Cyp153A16(G307A)-RedRhF(A796V) Fusion Protein Variant Q12W, Q28T, N309S, N407G, V451M, I480G (DNA) | 123 |
| Hybrid Cytochrome P450 Cyp153A16(G307A)-RedRhF(A796V) Fusion Protein Variant Q12W, Q28T, N309S, N407G, V451M, I480G (protein) | 124 |
| Hybrid Cytochrome P450 Cyp153A16(G307A)-RedRhF(A796V) Fusion Protein Variant D527E, D544N, R719W, E757A, V771F, M784I (DNA) | 125 |
| Hybrid Cytochrome P450 Cyp153A16(G307A)-RedRhF(A796V) Fusion Protein Variant D527E, D544N, R719W, E757A, V771F, M784I (protein) | 126 |
| Hybrid Cytochrome P450 Cyp153A16(G307A)-RedRhF(A796V) Fusion Protein Variant D527E, D544N, E557R (DNA) | 127 |
| Hybrid Cytochrome P450 Cyp153A16(G307A)-RedRhF(A796V) Fusion Protein Variant D527E, D544N, E557R (protein) | 128 |
| Hybrid Cytochrome P450 Cyp153A16(G307A)-RedRhF(A796V) Fusion Protein Variant T770G, M784I (DNA) | 129 |
| Hybrid Cytochrome P450 Cyp153A16(G307A)-RedRhF(A796V) Fusion Protein Variant T770G, M784I (protein) | 130 |
| Hybrid Cytochrome P450 Cyp153A16(G307A)-RedRhF(A796V) Fusion Protein Variant D527E, E591Q, V648L, R719W, E757A, V771F, M784I (DNA) | 131 |
| Hybrid Cytochrome P450 Cyp153A16(G307A)-RedRhF(A796V) Fusion Protein Variant D527E, E591Q, V648L, R719W, E757A, V771F, M784I (protein) | 132 |
| Hybrid Cytochrome P450 Cyp153A16(G307A)-RedRhF(A796V) Fusion Protein Variant D527E, E591Q, V648L, E757A, V771F (DNA) | 133 |
| Hybrid Cytochrome P450 Cyp153A16(G307A)-RedRhF(A796V) Fusion Protein Variant D527E, E591Q, V648L, E757A, V771F (protein) | 134 |
| Hybrid Cytochrome P450 Cyp153A16(G307A)-RedRhF(A796V) Fusion Protein Variant D527E, D544N, T770G, M784I (DNA) | 135 |
| Hybrid Cytochrome P450 Cyp153A16(G307A)-RedRhF(A796V) Fusion Protein Variant D527E, D544N, T770G, M784I (protein) | 136 |
| Hybrid Cytochrome P450 Cyp153A16(G307A)-RedRhF(A796V) Fusion Protein Variant D527E, E557R, T770G, M784I (DNA) | 137 |
| Hybrid Cytochrome P450 Cyp153A16(G307A)-RedRhF(A796V) Fusion Protein Variant D527E, E557R, T770G, M784I (protein) | 138 |
| Hybrid Cytochrome P450 Cyp153A16(G307A)-RedRhF(A796V) Fusion Protein Variant E557W, E757A, T770G (DNA) | 139 |
| Hybrid Cytochrome P450 Cyp153A16(G307A)-RedRhF(A796V) Fusion Protein Variant E557W, E757A, T770G (protein) | 140 |
| Hybrid Cytochrome P450 Cyp153A16(G307A)-RedRhF(A796V) Fusion Protein Variant E557R, E757A, V771F (DNA) | 141 |
| Hybrid Cytochrome P450 Cyp153A16(G307A)-RedRhF(A796V) Fusion Protein Variant E557R, E757A, V771F (protein) | 142 |
| Hybrid Cytochrome P450 Cyp153A16(G307A)-RedRhF(A796V) Fusion Protein Variant E757A, T770G (DNA) | 143 |
| Hybrid Cytochrome P450 Cyp153A16(G307A)-RedRhF(A796V) Fusion Protein Variant E757A, T770G (protein) | 144 |

The variants shown in Sequence Table C below are based on hybrid cytochrome P450 cyp153A(Q12W, R27L, K119R, S140N, S157R, V159M, S233L, A244R, G307A)-Red450RhF(A796V) fusion protein (SEQ ID NO: 98).

SEQUENCE TABLE C with Variants based on Hybrid Cytochrome P450 cyp153A(Q12W, R27L, K119R, S140N, S157R, V159M, S233L, A244R, G307A)-Red450RhF(A796V) Fusion Protein as shown in SEQ ID NO: 98*

| Description | Sequence Identifying Number (SEQ ID NO) |
|---|---|
| Hybrid Cytochrome P450 Cyp153A16(G307A)-RedRhF(A796V) Fusion Protein Variant V141T, A231Y, N407G (DNA) | 145 |
| Hybrid Cytochrome P450 Cyp153A16(G307A)-RedRhF(A796V) Fusion Protein Variant V141T, A231Y, N407G (protein) | 146 |
| Hybrid Cytochrome P450 Cyp153A16(G307A)-RedRhF(A796V) Fusion Protein Variant V141T, A231Y, L233S, R254G (DNA) | 147 |

SEQUENCE TABLE C with Variants based on Hybrid Cytochrome P450 cyp153A(Q12W, R27L, K119R, S140N, S157R, V159M, S233L, A244R, G307A)-Red450RhF(A796V) Fusion Protein as shown in SEQ ID NO: 98*

| Description | Sequence Identifying Number (SEQ ID NO) |
|---|---|
| Hybrid Cytochrome P450 Cyp153A16(G307A)-RedRhF(A796V) Fusion Protein Variant V141T, A231Y, L233S, R254G (protein) | 148 |
| Hybrid Cytochrome P450 Cyp153A16(G307A)-RedRhF(A796V) Fusion Protein Variant A231Y, N407G, V451M, E757A, T770G, M784I (DNA) | 149 |
| Hybrid Cytochrome P450 Cyp153A16(G307A)-RedRhF(A796V) Fusion Protein Variant A231Y, N407G, V451M, E757A, T770G, M784I (protein) | 150 |
| Hybrid Cytochrome P450 Cyp153A16(G307A)-RedRhF(A796V) Fusion Protein Variant V141T, A231Y, L233S, R244A (DNA) | 151 |
| Hybrid Cytochrome P450 Cyp153A16(G307A)-RedRhF(A796V) Fusion Protein Variant V141T, A231Y, L233S, R244A (protein) | 152 |
| Hybrid Cytochrome P450 Cyp153A16(G307A)-RedRhF(A796V) Fusion Protein Variant V141T, A231Y, R244A, V451M, E557W, E749L, T770G (DNA) | 153 |
| Hybrid Cytochrome P450 Cyp153A16(G307A)-RedRhF(A796V) Fusion Protein Variant V141T, A231Y, R244A, V451M, E557W, E749L, T770G (protein) | 154 |
| Hybrid Cytochrome P450 Cyp153A16(G307A)-RedRhF(A796V) Fusion Protein Variant L27R, Q28M, N61L, V141T, P149G, A231Y (DNA) | 155 |
| Hybrid Cytochrome P450 Cyp153A16(G307A)-RedRhF(A796V) Fusion Protein Variant L27R, Q28M, N61L, V141T, P149G, A231Y (protein) | 156 |
| Hybrid Cytochrome P450 Cyp153A16(G307A)-RedRhF(A796V) Fusion Protein Variant V141T, R157S, A231Y, L233S, R244A, E757A, M784I (DNA) | 157 |
| Hybrid Cytochrome P450 Cyp153A16(G307A)-RedRhF(A796V) Fusion Protein Variant V141T, R157S, A231Y, L233S, R244A, E757A, M784I (protein) | 158 |
| Hybrid Cytochrome P450 Cyp153A16(G307A)-RedRhF(A796V) Fusion Protein Variant A231Y, N407G, E591Q, R643H, E757A, M784I (DNA) | 159 |
| Hybrid Cytochrome P450 Cyp153A16(G307A)-RedRhF(A796V) Fusion Protein Variant A231Y, N407G, E591Q, R643H, E757A, M784I (protein) | 160 |
| Hybrid Cytochrome P450 Cyp153A16(G307A)-RedRhF(A796V) Fusion Protein Variant Q28M, N61L, N140S, V141T, A231Y, L233S, E271D (DNA) | 161 |
| Hybrid Cytochrome P450 Cyp153A16(G307A)-RedRhF(A796V) Fusion Protein Variant Q28M, N61L, N140S, V141T, A231Y, L233S, E271D (protein) | 162 |
| Hybrid Cytochrome P450 Cyp153A16(G307A)-RedRhF(A796V) Fusion Protein Variant A231Y, L233S, R254G, E557W (DNA) | 163 |
| Hybrid Cytochrome P450 Cyp153A16(G307A)-RedRhF(A796V) Fusion Protein Variant A231Y, L233S, R254G, E557W (protein) | 164 |

*Some mutations in the template SEQ ID NO: 98 are reverted to wild type. All variants contain the G307A and A796V mutation (SEQ ID NO: 38) and additional mutations.

The variants shown in Sequence Table D below are based on hybrid cytochrome P450 cyp153A(Q12W, R27L, K119R, S140N, S157R, V159M, S233L, A244R, G307A)-Red450RhF(A796V) fusion protein (SEQ ID NO: 98). In this table, all variants are depicted with the complete list of mutations (including the template mutations).

SEQUENCE TABLE D with Variants based on Hybrid Cytochrome P450 cyp153A(Q12W, R27L, K119R, S140N, S157R, V159M, S233L, A244R, G307A)-Red450RhF(A796V) Fusion Protein as shown in SEQ ID NO: 98*

| Description | Sequence Identifying Number (SEQ ID NO) |
|---|---|
| Hybrid Cytochrome P450 Cyp153A16(G307A)-RedRhF(A796V) Fusion Protein Variant Q12W, R27L, Q28M, K119R, V141T, S157R, V159M, A231Y, S233L, A244R (DNA) | 165 |
| Hybrid Cytochrome P450 Cyp153A16(G307A)-RedRhF(A796V) Fusion Protein Variant Q12W, R27L, Q28M, K119R, V141T, S157R, V159M, A231Y, S233L, A244R (protein) | 166 |
| Hybrid Cytochrome P450 Cyp153A16(G307A)-RedRhF(A796V) Fusion Protein Variant Q12W, Q28M, K119R, S140N, S157R, V159M, S233L, A244R, R254G, N407G (DNA) | 167 |

SEQUENCE TABLE D with Variants based on Hybrid Cytochrome P450 cyp153A(Q12W, R27L, K119R, S140N, S157R, V159M, S233L, A244R, G307A)-Red450RhF(A796V) Fusion Protein as shown in SEQ ID NO: 98*

| Description | Sequence Identifying Number (SEQ ID NO) |
|---|---|
| Hybrid Cytochrome P450 Cyp153A16(G307A)-RedRhF(A796V) Fusion Protein Variant Q12W, Q28M, K119R, S140N, S157R, V159M, S233L, A244R, R254G, N407G (protein) | 168 |
| Hybrid Cytochrome P450 Cyp153A16(G307A)-RedRhF(A796V) Fusion Protein Variant Q12W, R27L, F111A, K119R, V141T, S157R, V159M, A231Y, S233L, A244R, R254G (DNA) | 169 |
| Hybrid Cytochrome P450 Cyp153A16(G307A)-RedRhF(A796V) Fusion Protein Variant Q12W, R27L, F111A, K119R, V141T, S157R, V159M, A231Y, S233L, A244R, R254G (protein) | 170 |
| Hybrid Cytochrome P450 Cyp153A16(G307A)-RedRhF(A796V) Fusion Protein Variant Q12W, Q28M, K119R, S140N, P149G, S157R, V159M, A231Y, S233L, N407G (DNA) | 171 |
| Hybrid Cytochrome P450 Cyp153A16(G307A)-RedRhF(A796V) Fusion Protein Variant Q12W, Q28M, K119R, S140N, P149G, S157R, V159M, A231Y, S233L, N407G (protein) | 172 |
| Hybrid Cytochrome P450 Cyp153A16(G307A)-RedRhF(A796V) Fusion Protein Variant Q12W, R27L, Q28M, K119R, S140N, S157R, V159M, S233L, A244R, N407G (DNA) | 173 |
| Hybrid Cytochrome P450 Cyp153A16(G307A)-RedRhF(A796V) Fusion Protein Variant Q12W, R27L, Q28M, K119R, S140N, S157R, V159M, S233L, A244R, N407G (protein) | 174 |
| Hybrid Cytochrome P450 Cyp153A16(G307A)-RedRhF(A796V) Fusion Protein Variant D10Y, I11L, Q12W, Q28M, K119R, V141T, V159M, A231Y, S233L, A244R, N407G (DNA) | 175 |
| Hybrid Cytochrome P450 Cyp153A16(G307A)-RedRhF(A796V) Fusion Protein Variant D10Y, I11L, Q12W, Q28M, K119R, V141T, V159M, A231Y, S233L, A244R, N407G (protein) | 176 |
| Hybrid Cytochrome P450 Cyp153A16(G307A)-RedRhF(A796V) Fusion Protein Variant I11L, Q12W, R27L, Q28M, K119R, V141T, S157R, V159M, A197T, A231Y, S233L, A244R, N407G, P477G (DNA) | 177 |
| Hybrid Cytochrome P450 Cyp153A16(G307A)-RedRhF(A796V) Fusion Protein Variant I11L, Q12W, R27L, Q28M, K119R, V141T, S157R, V159M, A197T, A231Y, S233L, A244R, N407G, P477G (protein) | 178 |
| Hybrid Cytochrome P450 Cyp153A16(G307A)-RedRhF(A796V) Fusion Protein Variant I11L, Q12W, Q28M, K119R, V141T, S157R, V159M, A197T, A231Y, S233L, A244R, N407G (DNA) | 179 |
| Hybrid Cytochrome P450 Cyp153A16(G307A)-RedRhF(A796V) Fusion Protein Variant I11L, Q12W, Q28M, K119R, V141T, S157R, V159M, A197T, A231Y, S233L, A244R, N407G (protein) | 180 |
| Hybrid Cytochrome P450 Cyp153A16(G307A)-RedRhF(A796V) Fusion Protein Variant I11L, Q12W, R27L, Q28M, K119R, V141T, P149G, S157R, V159M, A231Y, S233L, N407G (DNA) | 181 |
| Hybrid Cytochrome P450 Cyp153A16(G307A)-RedRhF(A796V) Fusion Protein Variant I11L, Q12W, R27L, Q28M, K119R, V141T, P149G, S157R, V159M, A231Y, S233L, N407G (protein) | 182 |

*Some mutations in the template SEQ ID NO: 98 reverted to wild type. All variants contain the G307A and A796V mutation (SEQ ID NO: 38) and additional mutations.

Variations and Mutations

A variant polypeptide as used herein refers to a polypeptide having an amino acid sequence that differs from a wild-type CYP153A or template CYP153A-reductase hybrid fusion polypeptide by at least one amino acid. For example, the variant (e.g., mutant) can have one or more of the following conservative amino acid substitutions, including but not limited to, replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the variant polypeptide has about 1, 2, 3, 4, 5, 6, 7, 8, 9, 10, 15, 20, 30, 40, 50, 60, 70, 80, 90, 99, or more amino acid substitutions, additions, insertions, or deletions. The present disclosure encompasses fragments of the CYP153A-reductase hybrid fusion polypeptide variants of the present disclosure, wherein such fragments catalyze the conversion of a fatty acid to an omega-hydroxylated fatty acid, like the corresponding full length CYP153A-reductase hybrid fusion polypeptide variants. Preferably, such fragments of the disclosure provide upon expression in a recombinant host cell for a higher titer of an omega-hydroxylated fatty acid as compared to the titer of an omega-hydroxylated fatty acid produced by expression of a template CYP153A-reductase hybrid fusion polypeptide of, e.g., SEQ ID NO: 6 or SEQ ID NO: 38 in a corresponding host cell. Thus, fragments of a CYP153A-reductase hybrid fusion polypeptide variant or mutant of the present disclosure retain some or all of the biological function (e.g., enzymatic activity, specifically ω-hydroxylase enzymatic activity) of the corresponding full length CYP153A-reductase hybrid fusion polypeptide variant or mutant of the disclosure. Also, CYP153A-reductase hybrid fusion polypeptide variant fragments provided by the present disclosure retain some or all of the biological function (e.g., enzymatic activity, specifically ω-hydroxylase enzymatic activity) of a corresponding wild-type CYP153A polypeptide, or a corresponding template CYP153A-reductase hybrid fusion polypeptide, e.g., the CYP153A-reductase hybrid fusion polypeptide of SEQ ID NO: 6 or SEQ ID NO: 38. In some embodiments, the fragment retains at least 75%, at least 80%, at least 90%, at least 95%, or at least 98% or more of the biological function of a corresponding wild-type CYP153A polypeptide, or a corresponding full length CYP153A-reductase hybrid fusion polypeptide variant of the disclosure, or a corresponding template CYP153A-reductase hybrid fusion polypeptide. In other embodiments, the fragment or mutant retains about 100% of the biological function of a corresponding wild-type CYP153A polypeptide, or a corresponding full length CYP153A-reductase hybrid fusion polypeptide variant of the disclosure, or a corresponding template CYP153A-reductase hybrid fusion polypeptide. In other embodiments, some fragments exhibit increased biological function as compared to a corresponding wild-type CYP153A polypeptide, or a corresponding template CYP153A-reductase hybrid fusion polypeptide. Guidance in determining which amino acid residues may be substituted, inserted, or deleted without affecting biological activity may be found using computer programs well known in the art, for example, LASERGENE software (DNASTAR, Inc., Madison, Wis.). In some embodiments, a fragment exhibits increased biological function as compared to a corresponding wild-type CYP153A polypeptide, or a corresponding, or a corresponding template CYP153A-reductase hybrid fusion polypeptide. For example, a fragment may display at least a 10%, at least a 25%, at least a 50%, at least a 75%, or at least a 90% improvement in enzymatic activity as compared to a corresponding wild-type CYP153A polypeptide, or a corresponding template CYP153A-reductase hybrid fusion polypeptide. In other embodiments, the fragment displays at least 100%, at least 200%, or at least 500% improvement in enzymatic activity as compared to a corresponding wild-type CYP153A polypeptide, or a corresponding template CYP153A-reductase hybrid fusion polypeptide. In accordance with the fact that the present disclosure encompasses fragments of the CYP153A-reductase hybrid fusion polypeptide variants of the present disclosure as mentioned above, it is to be understood that all structural and functional technical properties, which are described herein in relation to the CYP153A-reductase hybrid fusion polypeptide variants of the disclosure also apply to fragments of the CYP153A-reductase hybrid fusion polypeptide variants of the disclosure, though reference to such fragments may not explicitly be made herein at each place where structural and functional technical properties of the CYP153A-reductase hybrid fusion polypeptide variants of the disclosure are described.

It is understood that the polypeptides described herein may have additional conservative or non-essential amino acid substitutions which do not have a substantial effect on the polypeptide function. Whether or not a particular substitution will be tolerated (i.e., will not adversely affect the desired biological function, such as ω-hydroxylase enzymatic activity), can be determined as known in the art (see Bowie et al. (1990) Science, 247:1306-1310). A conservative amino acid substitution is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine), and aromatic side chains (e.g., tyrosine, phenylalanine, tryptophan, histidine).

Variants can be naturally occurring or created in vitro. In particular, such variants can be created using genetic engineering techniques, such as site directed mutagenesis, random chemical mutagenesis, Exonuclease III deletion procedures, or standard cloning techniques. Alternatively, such variants, mutants, fragments, analogs, or derivatives can be created using chemical synthesis or modification procedures. Methods of making variants are well known in the art. For example, variants can be prepared by using random and site-directed mutagenesis. Random and site-directed mutagenesis are generally known in the art (see, for example, Arnold (1993) Curr. Opin. Biotech. 4:450-455). Random mutagenesis can be achieved using error prone PCR (see, for example, Leung et al. (1989) Technique 1:11-15; and Caldwell et al. (1992) PCR Methods Applic. 2: 28-33). In error prone PCR, the actual PCR is performed under conditions where the copying fidelity of the DNA polymerase is low, such that a high rate of point mutations is obtained along the entire length of the PCR product. Briefly, in such procedures, nucleic acids to be mutagenized (e.g., a polynucleotide sequence encoding a P450 protein or P450 hybrid fusion polypeptide) are mixed with PCR primers, reaction buffer, $MgCl_2$, $MnCl_2$, Taq polymerase, and an appropriate concentration of dNTPs for achieving a high rate of point mutation along the entire length of the PCR product. For example, the reaction can be performed using 20 fmoles of nucleic acid to be mutagenized, 30 pmole of each PCR primer, a reaction buffer comprising 50 mM KCl, 10 mM Tris HCl (pH 8.3), 0.01% gelatin, 7 mM $MgCl_2$, 0.5 mM $MnCl_2$, 5 units of Taq polymerase, 0.2 mM dGTP, 0.2 mM dATP, 1 mM dCTP, and 1 mM dTTP. PCR can be performed for 30 cycles of 94° C. for 1 min, 45° C. for 1 min, and 72° C. for 1 min. However, it will be appreciated by those in the art that these parameters can be varied as appropriate. The mutagenized nucleic acids are then cloned into an appropriate vector, and the activities of the polypeptides encoded by the mutagenized nucleic acids are evaluated. Site-directed mutagenesis can be achieved using oligonucleotide-directed mutagenesis to generate site-specific mutations in any cloned DNA of interest. Oligonucleotide mutagenesis is described in the art (see, for example, Reidhaar-Olson et al. (1988) Science 241:53-57). Briefly, in such procedures a plurality of double stranded oligonucleotides bearing one or more mutations to be introduced into the cloned DNA are synthesized and inserted into the cloned DNA to be mutagenized (e.g., a polynucleotide sequence encoding a P450 polypeptide or P450 hybrid fusion polypeptide). Clones containing the mutagenized DNA are recovered, and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction (see U.S. Pat. No. 5,965,408). Still another method of generating variants is sexual PCR mutagenesis. In sexual PCR mutagenesis, forced homologous recombination occurs between DNA molecules of different, but highly related, DNA sequences in vitro as a result of random fragmentation of the DNA molecule based on sequence homology. This is followed by fixation of the crossover by primer extension in a PCR reaction. Sexual PCR mutagenesis is described publications known in the art (see, for example, Stemmer (1994) *Proc. Natl. Acad. Sci. U.S.A.* 91:10747-10751). Variants can also be created by in vivo mutagenesis. In some embodiments, random mutations in a nucleic acid sequence are generated by propagating the sequence in a bacterial strain, such as an *E. coli* strain, which carries mutations in one or more of the DNA repair pathways. Such mutator strains have a higher random mutation rate than that of a wild-type strain. Propagating a DNA sequence (e.g., a polynucleotide sequence encoding an P450 hybrid fusion polypeptide) in one of these strains will eventually generate random mutations within the DNA. Mutator strains suitable for use for in vivo mutagenesis are described in publication in the art (see, for example, International Patent Application Publication No. WO1991/016427). Variants can also be generated using cassette mutagenesis. In cassette mutagenesis, a small region of a double-stranded DNA molecule is replaced with a synthetic oligonucleotide cassette that differs from the native sequence. The oligonucleotide often contains a completely and/or partially randomized native sequence. Recursive ensemble mutagenesis can also be used to generate variants. Recursive ensemble mutagenesis is an algorithm for protein engineering (i.e., protein mutagenesis) developed to produce diverse populations of phenotypically related mutants whose members differ in amino acid sequence. This method uses a feedback mechanism to control successive rounds of combinatorial cassette mutagenesis (see, for example, Arkin et al. (1992) *Proc. Natl. Acad. Sci., U.S.A.* 89:7811-7815). In some embodiments, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins (see, for example, Delegrave et al. (1993) *Biotech. Res.* 11:1548-1552). In some embodiments, variants are created using shuffling procedures wherein portions of a plurality of nucleic acids that encode distinct polypeptides are fused together to create chimeric nucleic acid sequences that encode chimeric polypeptides (as described in, for example, U.S. Pat. Nos. 5,965,408 and 5,939,250).

Motif and Structure

Figure 6:
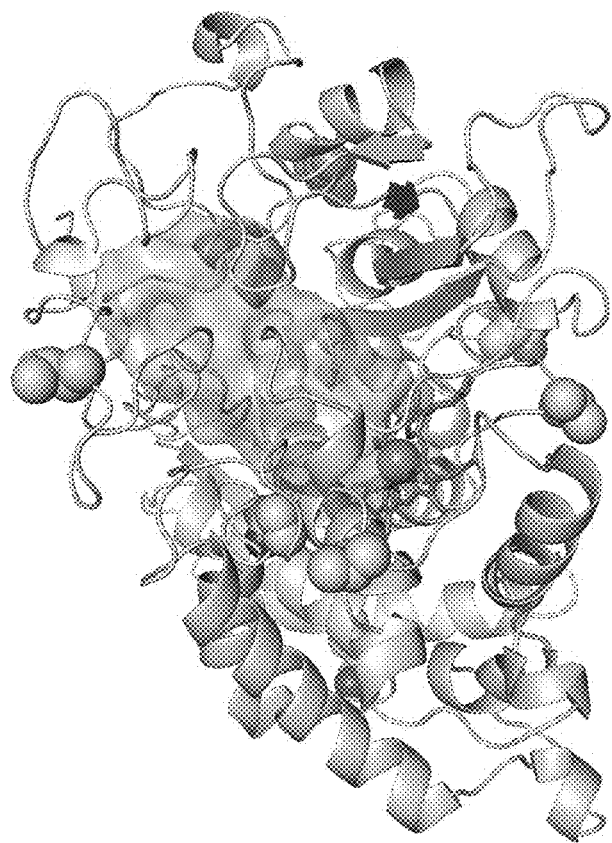
FIG. 6 depicts the three-dimensional protein structure of SEQ ID NO: 98. The balls depict the carbon, nitrogen and oxygen atoms on the mutated residues. Also shown near the center is the heme group clustered around an iron atom in the middle. The potential ligand binding site is illustrated as a grayed-out surface. As can be seen on this picture, all mutated residues are outside the potential ligand binding site (i.e., active site).

The identification and characterization of a CYP153A (G307A) mutant is described in Honda Malca et al. (supra), wherein the authors investigated potential substrate-interacting residues in CYP153A. Honda Malca et al. performed a structure-based analysis focusing on the identification of key residues in structural elements that contain amino acids pointing with their side chains towards the heme center and are thus expected to be in contact with every substrate molecule during the attack of the activated oxygen. To that end, position G307 was identified as one of the two hotspot positions, which can be identified from the protein structure, and which is also part of the active site of a previously described homology model built for CYP153A6. In comparison, the present disclosure is based on generating random mutations in an effort to improve product output (see Examples for saturation libraries as shown in Tables 5-11, infra). For example, the variant of SEQ ID NO: 98 is based on SEQ ID NO: 38 (harboring the G307A and A796V mutation) and has additional mutations including Q12W, R27L, K119R, S140N, S157R, V159M, S233L and A244R of which none are located in the active site of the CYP153A domain based on three-dimensional modeling (see FIG. 6).

Figure 5:
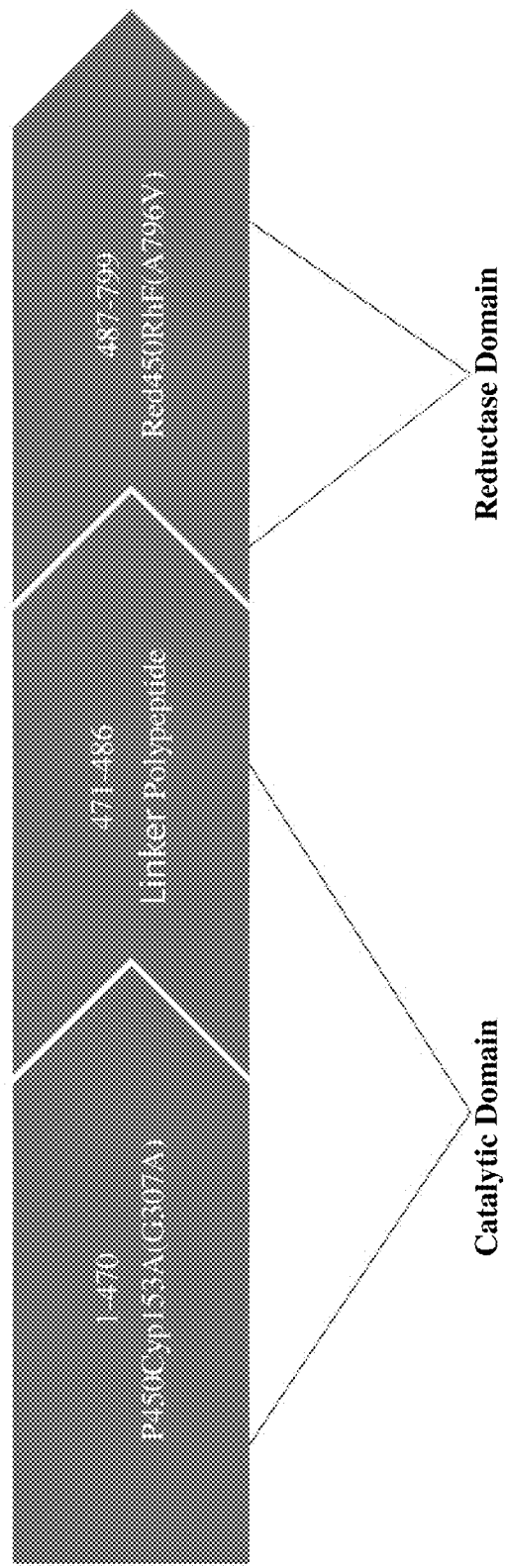
FIG. 5 shows the structure of the cytochrome P450 Cyp153A(G307A)-RedRhF(A796V) hybrid fusion polypeptide variant of SEQ ID NO: 38 which has two distinct domains, i.e., a catalytic and a reductase domain which are connected by a linker polypeptide. The catalytic domain is shown to range from amino acid position 1 to 486 and includes P450 Cyp153A(G307A) which ranges from amino acid position 1 to 470 and a linker polypeptide that ranges from amino acid position 471 to 486. The reductase domain, shown as Red450RhF(A796V) ranges from amino acid position 487 to 799. SEQ ID NO: 38 is used as a template sequence for creating additional variants.

CYP153A is a globular protein and its catalytically active site involves the amino acid residues that are adjacent to the heme group where the chemistry of substrate hydroxylation occurs. FIG. 5 depicts the CYP153A catalytic domain next to the reductase domain within the CYP153A-reductase hybrid fusion polypeptide. Position G307 is in close proximity to the heme in the active site. However, the present disclosure shows that the catalytic properties of CYP153A can be improved when mutating specific positions that are not necessarily in the active site of the protein such as, for example, positions 12, 27, 28, 119, 141, 157, 159, 231, 233, and 244 of SEQ ID NO: 38; positions 12, 28, 119, 140, 157, 159, 233, 244, 254, and 407 of SEQ ID NO: 38; positions 12, 27, 111, 119, 141, 157, 159, 231, 233, 244, and 254 of SEQ ID NO: 38; positions 12, 28, 119, 140, 149, 157, 159, 231, 233, and 407 of SEQ ID NO: 38; positions 12, 27, 28, 119, 140, 157, 159, 233, 244, and 407 of SEQ ID NO: 38; positions 10, 11, 12, 28, 119, 141, 159, 231, 233, 244, and 407 of SEQ ID NO: 38; positions 11, 12, 27, 28, 119, 141, 157, 159, 197, 231, 233, 244, 407, and 477 of SEQ ID NO: 38; positions 11, 12, 28, 119, 141, 157, 159, 197, 231, 233, 244, and 407 of SEQ ID NO: 38; and/or positions 11, 12, 27, 28, 119, 141, 149, 157, 159, 231, 233, and 407 of SEQ ID NO: 38. Examples of specific variants that improve catalytic properties are Q12W, R27L, Q28M, K119R, V141T, S157R, V159M, A231Y, S233L, A244R (SEQ ID NO: 166); Q12W, Q28M, K119R, S140N, S157R, V159M, S233L, A244R, R254G, N407G (SEQ ID NO: 168); Q12W, R27L, F111A, K119R, V141T, S157R, V159M, A231Y, S233L, A244R, R254G (SEQ ID NO: 170); Q12W, Q28M, K119R, S140N, P149G, S157R, V159M, A231Y, S233L, N407G (SEQ ID NO: 172); Q12W, R27L, Q28M, K119R, S140N, S157R, V159M, S233L, A244R, N407G (SEQ ID NO: 174); D10Y, I11L, Q12W, Q28M, K119R, V141T, V159M, A231Y, S233L, A244R, N407G (SEQ ID NO: 176); I11L, Q12W, R27L, Q28M, K119R, V141T, S157R, V159M, A197T, A231Y, S233L, A244R, N407G, P477G (SEQ ID NO: 178); I11L, Q12W, Q28M, K119R, V141T, S157R, V159M, A197T, A231Y, S233L, A244R, N407G (SEQ ID NO: 180); and I11L, Q12W, R27L, Q28M, K119R, V141T, P149G, S157R, V159M, A231Y, S233L, N407G (SEQ ID NO: 182).

Host Cells

Strategies to increase production of ω-OH fatty acid compositions by recombinant host cells include increased flux through the fatty acid biosynthetic pathway by expressing a CYP153A-reductase hybrid fusion gene and a thioesterase gene in the production host. As used herein, the term recombinant host cell or engineered host cell refers to a host cell whose genetic makeup has been altered relative to the corresponding wild-type host cell, for example, by deliberate introduction of new genetic elements and/or deliberate modification of genetic elements naturally present in the host cell. The offspring of such recombinant host cells also contain these new and/or modified genetic elements. In any of the aspects of the disclosure described herein, the host cell can be selected from a plant cell, insect cell, fungus cell (e.g., a filamentous fungus, such as *Candida* sp., or a budding yeast, such as *Saccharomyces* sp.), an algal cell and a bacterial cell. In one embodiment, recombinant host cells are recombinant microorganisms. Examples of host cells that are microorganisms include, but are not limited to, cells from the genus *Escherichia*, *Bacillus*, *Lactobacillus*, Zymomonas, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Stenotrophamonas, Schizosaccharomyces, Yarrowia, or Streptomyces. In some embodiments, the host cell is a Gram-positive bacterial cell. In other embodiments, the host cell is a Gram-negative bacterial cell. In some embodiments, the host cell is an *E. coli* cell. In some embodiment, the host cell is an *E. coli* B cell, an *E. coli* C cell, an *E. coli* K cell, or an *E. coli* W cell. In other embodiments, the host cell is a *Bacillus lentus* cell, a *Bacillus brevis* cell, a *Bacillus stearothermophilus* cell, a *Bacillus* lichenoformis cell, a *Bacillus alkalophilus* cell, a *Bacillus coagulans* cell, a *Bacillus circulans* cell, a *Bacillus pumilis* cell, a *Bacillus thuringiensis* cell, a *Bacillus clausii* cell, a *Bacillus megaterium* cell, a *Bacillus subtilis* cell, or a *Bacillus amyloliquefaciens* cell. In other embodiments, the host cell is a *Trichoderma koningii* cell, a *Trichoderma viride* cell, a *Trichoderma reesei* cell, a *Trichoderma longibrachiatum* cell, an *Aspergillus awamori* cell, an *Aspergillus fumigates* cell, an *Aspergillus foetidus* cell, an *Aspergillus nidulans* cell, an *Aspergillus niger* cell, an *Aspergillus oryzae* cell, a *Humicola insolens* cell, a *Humicola lanuginose* cell, a *Rhodococcus opacus* cell, a *Rhizomucor miehei* cell, or a *Mucormichei* cell. In yet other embodiments, the host cell is a *Streptomyces lividans* cell or a *Streptomyces murinus* cell. In yet other embodiments, the host cell is an *Actinomycetes* cell. In some embodiments, the host cell is a *Saccharomyces cerevisiae* cell.

In other embodiments, the host cell is a eukaryotic plant cell, an alga cell, a cyanobacterium cell, a green-sulfur bacterium cell, a green non-sulfur bacterium cell, a purple sulfur bacterium cell, a purple non-sulfur bacterium cell, an extremophile cell, a yeast cell, a fungus cell, an engineered cell of any of the organisms described herein, or a synthetic organism. In some embodiments, the host cell is light-dependent or fixes carbon. In some embodiments, the host cell has autotrophic activity. In some embodiments, the host cell has photoautotrophic activity, such as in the presence of light. In some embodiments, the host cell is heterotrophic or mixotrophic in the absence of light. In certain embodiments, the host cell is a cell from *Arabidopsis thaliana, Panicum virgatum, Miscanthus giganteus, Zea mays, Botryococcuse braunii, Chlamydomonas reinhardtii, Dunaliela salina,* Synechococcus Sp. PCC 7002, Synechococcus Sp. PCC 7942, *Synechocystis* Sp. PCC 6803, *Thermosynechococcus elongates* BP-1, *Chlorobium tepidum, Chlorojlexus auranticus, Chromatiumm vinosum, Rhodospirillum rubrum, Rhodobacter capsulatus, Rhodopseudomonas palusris, Clostridium ljungdahlii, Clostridium thermocelhtm, Penicillium chrysogenum, Pichia pastoris, Saccharomyces cerevisiae, Schizosaccharomyces pombe, Pseudomonas fluorescens,* or *Zymomonas mobilis*. In one embodiment, the microbial cell is from a cyanobacteria including, but not limited to, *Prochlorococcus, Synechococcus, Synechocystis, Cyanothece,* and *Nostoc punctiforme*. In another embodiment, the microbial cell is from a specific cyanobacterial species including, but not limited to, *Synechococcus elongatus* PCC7942, *Synechocystis* sp. PCC6803, and Synechococcus sp. PCC7001.

Expression Vectors

In some embodiments, a polynucleotide (or gene) sequence is provided to the host cell by way of a recombinant vector, which includes a promoter operably linked to the polynucleotide sequence. In certain embodiments, the promoter is a developmentally-regulated, an organelle-specific, a tissue-specific, an inducible, a constitutive, or a cell-specific promoter. In some embodiments, the recombinant vector includes at least one sequence selected from an expression control sequence operatively coupled to the polynucleotide sequence; a selection marker operatively coupled to the polynucleotide sequence; a marker sequence operatively coupled to the polynucleotide sequence; a purification moiety operatively coupled to the polynucleotide sequence; a secretion sequence operatively coupled to the polynucleotide sequence; and a targeting sequence operatively coupled to the polynucleotide sequence. The expression vectors described herein include a polynucleotide sequence in a form suitable for expression of the polynucleotide sequence in a host cell. It will be appreciated by those skilled in the art that the design of the expression vector can depend on such factors as the choice of the host cell to be transformed, the level of expression of polypeptide desired, and the like. The expression vectors described herein can be introduced into host cells to produce polypeptides, including fusion polypeptides, encoded by the polynucleotide sequences as described above (supra). Expression of genes encoding polypeptides in prokaryotes, for example, *E. coli*, is most often carried out with vectors containing constitutive or inducible promoters directing the expression of either fusion or non-fusion polypeptides. Fusion vectors add a number of amino acids to a polypeptide encoded therein, usually to the amino- or carboxy-terminus of the recombinant polypeptide. Such fusion vectors typically serve one or more of the following three purposes including increasing expression of the recombinant polypeptide; increasing the solubility of the recombinant polypeptide; and aiding in the purification of the recombinant polypeptide by acting as a ligand in affinity purification. Often, in fusion expression vectors, a proteolytic cleavage site is introduced at the junction of the fusion moiety and the recombinant polypeptide. This allows separation of the recombinant polypeptide from the fusion moiety after purification of the fusion polypeptide. Examples of such enzymes, and their cognate recognition sequences, include Factor Xa, thrombin, and enterokinase. Exemplary fusion expression vectors include pGEX vector (Pharmacia Biotech, Inc., Piscataway, N.J.; Smith et al. (1988) *Gene* 67:31-40), pMAL vector (New England Biolabs, Beverly, Mass.), and pRITS vector (Pharmacia Biotech, Inc., Piscataway, N.J.), which fuse glutathione S-transferase (GST), maltose E binding protein, or protein A, respectively, to the target recombinant polypeptide.

Examples of inducible, non-fusion *E. coli* expression vectors include pTrc vector (Amann et al. (1988) *Gene* 69:301-315) and pET 11d vector (Studier et al., Gene Expression Technology: Methods in Enzymology 185, Academic Press, San Diego, Calif. (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains such as BL21(DE3) or HMS174(DE3) from a resident λ prophage harboring a T7 gn1 gene under the transcriptional control of the lacUV 5 promoter. Suitable expression systems for both prokaryotic and eukaryotic cells are well known in the art (see, e.g., Sambrook et al. (1989) *Molecular Cloning: A Laboratory Manual,* second edition, Cold Spring Harbor Laboratory). Examples of inducible, non-fusion *E. coli* expression vectors include pTrc vector (Amann et al. (1988) *Gene* 69:301-315) and PET 11d vector (Studier et al. (1990) Gene Expression Technology: Methods in Enzymology 185, Academic Press, San Diego, Calif., pp. 60-89). In certain embodiments, a polynucleotide sequence of the disclosure is operably linked to a promoter derived from bacteriophage T5. In one embodiment, the host cell is a yeast cell. In this embodiment, the expression vector is a yeast expression vector. Vectors can be introduced into prokaryotic or eukaryotic cells via a variety of art-recognized techniques for introducing foreign nucleic acid (e.g., DNA) into a host cell. Suitable methods for transforming or transfecting host cells can be found in, for example, Sambrook et al. (supra). For stable transformation of bacterial cells, it is known that (depending upon the expression vector and transformation technique used) a certain fraction of cells will take-up and replicate the expression vector. In order to identify and select these transformants, a gene that encodes a selectable marker (e.g., resistance to an antibiotic) can be introduced into the host cells along with the gene of interest. Selectable markers include those that confer resistance to drugs such as, but not limited to, ampicillin, kanamycin, chloramphenicol, or tetracycline. Nucleic acids encoding a selectable marker can be introduced into a host cell on the same vector as that encoding a polypeptide described herein or can be introduced on a separate vector.

Optional Pathway Engineering

The host cells or microorganisms of the disclosure include host strains or host cells that are genetically engineered or modified to contain alterations in order to test the efficiency of specific mutations on enzymatic activities (i.e., recombinant cells or microorganisms). Various optional genetic manipulations and alterations can be used interchangeably from one host cell to another, depending on what native enzymatic pathways are present in the original host cell. In one embodiment, a host strain can be used for testing the expression of a CYP153A-reductase hybrid fusion polypeptide variant in combination with other biosynthetic polypeptides (e.g., enzymes). A host strain may encompasses a number of genetic alterations in order to test specific variables, including but not limited to, culture conditions including fermentation components, carbon source (e.g., feedstock), temperature, pressure, reduced culture contamination conditions, and oxygen levels.

In one embodiment, a host strain encompasses an optional fadE and JhuA deletion. Acyl-CoA dehydrogenase (FadE) is an enzyme that is important for metabolizing fatty acids. It catalyzes the second step in fatty acid utilization (beta-oxidation), which is the process of breaking long chains of fatty acids (acyl-CoAs) into acetyl-CoA molecules. More specifically, the second step of the β-oxidation cycle of fatty acid degradation in bacteria is the oxidation of acyl-CoA to 2-enoyl-CoA, which is catalyzed by FadE. When $E.$ $coli$ lacks FadE, it cannot grow on fatty acids as a carbon source but it can grow on acetate. The inability to utilize fatty acids of any chain length is consistent with the reported phenotype of fadE strains, i.e., fadE mutant strains where FadE function is disrupted. The fadE gene can be optionally knocked out or attenuated to assure that acyl-CoAs, which may be intermediates in a fatty acid derivative pathway, can accumulate in the cell such that all acyl-CoAs can be efficiently converted to fatty acid derivatives. However, fadE attenuation is optional when sugar is used as a carbon source since under such condition expression of FadE is likely repressed and FadE therefore may only be present in small amounts and not able to efficiently compete with ester synthase or other enzymes for acyl-CoA substrates. FadE is repressed due to catabolite repression. $E.$ $coli$ and many other microbes prefer to consume sugar over fatty acids, so when both sources are available sugar is consumed first by repressing the fad regulon (see D. Clark, $J$ $Bacteriol.$ (1981) 148(2):521-6)). Moreover, the absence of sugars and the presence of fatty acids induces FadE expression. Acyl-CoA intermediates could be lost to the beta oxidation pathway since the proteins expressed by the fad regulon (including FadE) are up-regulated and will efficiently compete for acyl-CoAs. Thus, it can be beneficial to have the fadE gene knocked out or attenuated. Since most carbon sources are mainly sugar based, it is optional to attenuate FadE. The gene fhuA codes for the fhuA protein, which is an energy-coupled transporter and receptor in the outer membrane of $E.$ $coli$ (V. Braun (2009) $J$ $Bacteriol.$ 191(11):3431-3436). Its deletion is optional. The fhuA deletion allows the cell to become more resistant to phage attack which can be beneficial in certain fermentation conditions. Thus, it may be desirable to delete fhuA in a host cell that is likely subject to potential contamination during fermentation runs.

In another embodiment, the host strain (supra) also encompasses optional overexpression of one or more of the following genes including fadR, fabA, fabD, fabG, fabH, fabV, and/or fabF. Examples of such genes are fadR from $Escherichia$ $coli$, fabA from $Salmonella$ $typhimurium$ (NP_460041), fabD from $Salmonella$ $typhimurium$ (NP_460164), fabG from $Salmonella$ $typhimurium$ (NP_460165), fabH from $Salmonella$ $typhimurium$ (NP_460163), fabV from $Vibrio$ $cholera$ (YP_001217283), and fabF from $Clostridium$ $acetobutylicum$ (NP_350156). The overexpression of one or more of these genes, which code for enzymes and regulators in fatty acid biosynthesis, can serve to increase the titer of fatty-acid derivative compounds including ω-OH fatty acids and derivatives thereof under various culture conditions.

In another embodiment, $E.$ $coli$ strains are used as host cells for the production of ω-OH fatty acids and derivatives thereof. Similarly, these host cells provide optional overexpression of one or more biosynthesis genes (i.e., genes coding for enzymes and regulators of fatty acid biosynthesis) that can further increase or enhance the titer of fatty-acid derivative compounds such as fatty acid derivatives (e.g., ω-OH fatty acids and α,ω-diacids, etc.) under various culture conditions including, but not limited to, fadR, fabA, fabD, fabG, fabH, fabV and/or fabF. Examples of genetic alterations include fadR from $Escherichia$ $coli,$ $fabA$ from $Salmonella$ $typhimurium$ (NP_460041), fabD from $Salmonella$ $typhimurium$ (NP_460164), fabG from $Salmonella$ $typhimurium$ (NP_460165), fabH from $Salmonella$ $typhimurium$ (NP_460163), fabV from $Vibrio$ $cholera$ (YP_001217283), and fabF from $Clostridium$ $acetobutylicum$ (NP_350156). In some embodiments, synthetic operons that carry these biosynthetic genes can be engineered and expressed in cells in order to test P450 expression under various culture conditions and/or further enhance ω-OH fatty acid and α,ω-diacid production. Such synthetic operons contain one or more biosynthetic gene. An engineered operon may contain optional fatty acid biosynthetic genes, including fabV from $Vibrio$ $cholera,$ fabH from $Salmonella$ $typhimurium,$ fabD from $S.$ $typhimurium,$ fabG from $S.$ $typhimurium,$ $fabA$ from $S.$ $typhimurium$ and/or fabF from $Clostridium$ $acetobutylicum$ that may be used to facilitate overexpression of fatty acid derivatives in order to test specific culture conditions. One advantage of such synthetic operons is that the rate of ω-OH fatty acid derivative production may be further increased or enhanced.

In some embodiments, the host cells or microorganisms that are used to express ACP and biosynthetic enzymes (e.g., ω-hydroxylase, thioesterase, etc.) will further express genes that encompass certain enzymatic activities that can increase the production to one or more particular fatty acid derivative(s) such as ω-OH fatty acids, ω-OH fatty acid derivatives, α,ω-diacids and the like. In one embodiment, the host cell has thioesterase activity (E.C. 3.1.2.* or E.C. 3.1. 2.14 or E.C. 3.1.1.5) for the production of fatty acids which can be increased by overexpressing the gene. In another embodiment, the host cell has ester synthase activity (E.C. 2.3.1.75) for the production of fatty esters. In another embodiment, the host cell has acyl-ACP reductase (AAR) (E.C. 1.2.1.80) activity and/or alcohol dehydrogenase activity (E.C. 1.1.1.1.) and/or fatty alcohol acyl-CoA reductase (FAR) (E.C. 1.1.1.*) activity and/or carboxylic acid reductase (CAR) (EC 1.2.99.6) activity for the production of fatty alcohols. In another embodiment, the host cell has acyl-ACP reductase (AAR) (E.C. 1.2.1.80) activity for the production of fatty aldehydes. In another embodiment, the host cell has acyl-ACP reductase (AAR) (E.C. 1.2.1.80) activity and decarbonylase (ADC) activity for the production of alkanes and alkenes. In another embodiment, the host cell has acyl-CoA reductase (E.C. 1.2.1.50) activity, acyl-CoA synthase (FadD) (E.C. 2.3.1.86) activity, and thioesterase (E.C. 3.1.2.* or E.C. 3.1. 2.14 or E.C. 3.1.1.5) activity for the production of fatty alcohols. In another embodiment, the host cell has ester synthase activity (E.C. 2.3.1.75), acyl-CoA synthase (FadD) (E.C. 2.3.1.86) activity, and thioesterase (E.C. 3.1.2.* or E.C. 3.1. 2.14 or E.C. 3.1.1.5) activity for the production of fatty esters. In another embodiment, the host cell has OleA activity for the production of ketones. In another embodiment, the host cell has OleBCD activity for the production of internal olefins. In another embodiment, the host cell has acyl-ACP reductase (AAR) (E.C. 1.2.1.80) activity and alcohol dehydrogenase activity (E.C. 1.1.1.1.) for the production of fatty alcohols. In another embodiment, the host cell has thioesterase (E.C. 3.1.2.* or E.C. 3.1. 2.14 or E.C. 3.1.1.5) activity and decarboxylase activity for making terminal olefins. The expression of enzymatic activities in microorganisms and microbial cells is taught by U.S. Pat. Nos. 8,097,439; 8,110,093; 8,110,670; 8,183,028; 8,268,599; 8,283,143; 8,232,924; 8,372,610; and 8,530,221, which are incorporated herein by reference. In other embodiments, the host cells or microorganisms that are used to express ACP and other biosynthetic enzymes will include certain native enzyme activities that are upregulated or overexpressed in order to produce one or more particular fatty acid derivative(s) such as ω-OH fatty acids, ω-OH fatty acid derivatives, and α,ω-diacids. In one embodiment, the host cell has a native thioesterase (E.C. 3.1.2.* or E.C. 3.1. 2.14 or E.C. 3.1.1.5) activity for the production of fatty acids which can be increased by overexpressing the thioesterase gene.

The present disclosure includes host strains or microorganisms that express genes that code for CYP153A-reductase hybrid fusion polypeptide variants and other biosynthetic enzymes (supra). The recombinant host cells produce fatty acid derivatives such as ω-OH fatty acids, ω-OH fatty acid derivatives, α,ω-diacids and compositions and blends thereof. The fatty acid derivatives are typically recovered from the culture medium and/or are isolated from the host cells. In one embodiment, the fatty acid derivatives are recovered from the culture medium (extracellular). In another embodiment, the fatty acid derivatives are isolated from the host cells (intracellular). In another embodiment, the fatty acid derivatives are recovered from the culture medium and isolated from the host cells. The fatty acid derivatives or compositions produced by a host cell can be analyzed using methods known in the art, for example, GC-FID, in order to determine the distribution of particular fatty acid derivatives as well as chain lengths and degree of saturation of the components of the ω-OH fatty acid derivatives such as ω-OH fatty acids, ω-OH fatty esters, α,ω-diacids, and the like.

Culture and Fermentation

As used herein, the term fermentation broadly refers to the conversion of organic materials into target substances by host cells, for example, the conversion of a carbon source by recombinant host cells into ω-OH fatty acids or derivatives thereof by propagating a culture of the recombinant host cells in a media comprising the carbon source. The conditions permissive for the production refer to any conditions that allow a host cell to produce a desired product, such as ω-OH fatty acids. Similarly, the condition or conditions in which the polynucleotide sequence of a vector is expressed means any conditions that allow a host cell to synthesize a polypeptide. Suitable conditions include, for example, fermentation conditions. Fermentation conditions can include many parameters including, but not limited to, temperature ranges, levels of aeration, feed rates and media composition. Each of these conditions, individually and in combination, allows the host cell to grow. Fermentation can be aerobic, anaerobic, or variations thereof (such as micro-aerobic). Exemplary culture media include broths or gels. Generally, the medium includes a carbon source that can be metabolized by a host cell directly. In addition, enzymes can be used in the medium to facilitate the mobilization (e.g., the depolymerization of starch or cellulose to fermentable sugars) and subsequent metabolism of the carbon source.

For small scale production, the engineered host cells can be grown in batches of, for example, about 100 μL, 200 μL, 300 μL, 400 μL, 500 μL, 1 mL, 5 mL, 10 mL, 15 mL, 25 mL, 50 mL, 75 mL, 100 mL, 500 mL, 1 μL, 2 μL, 5 μL, or 10 μL; fermented; and induced to express a desired polynucleotide sequence, such as a polynucleotide sequence encoding a P450 hybrid fusion polypeptide. For large scale production, the engineered host cells can be grown in batches of about 10 μL, 100 μL, 1000 μL, 10,000 μL, 100,000 μL, and 1,000,000 μL or larger; fermented; and induced to express a desired polynucleotide sequence. Alternatively, large scale fed-batch fermentation may be carried out. The ω-OH fatty acids, derivatives and compositions thereof as described herein are found in the extracellular environment of the recombinant host cell culture and can be readily isolated from the culture medium. An ω-OH fatty acid or derivative thereof may be secreted by the recombinant host cell, transported into the extracellular environment or passively transferred into the extracellular environment of the recombinant host cell culture. The ω-OH fatty acids or derivatives thereof are isolated from a recombinant host cell culture using routine methods known in the art.

Products Derived from Recombinant Host Cells

As used herein, the fraction of modem carbon or fM has the same meaning as defined by National Institute of Standards and Technology (NIST) Standard Reference Materials (SRMs4990B and 4990C, known as oxalic acids standards HOxI and HOxII, respectively. The fundamental definition relates to 0.95 times the $^{14}C/^{12}C$ isotope ratio HOxI (referenced to AD 1950). This is roughly equivalent to decay-corrected pre-Industrial Revolution wood. For the current living biosphere (plant material), fM is approximately 1.1. Bioproducts (e.g., the fatty acid derivatives including ω-OH fatty acids and derivatives produced in accordance with the present disclosure) include biologically produced organic compounds. In particular, the fatty acid derivatives (e.g., ω-OH fatty acids and derivatives thereof) produced using the fatty acid biosynthetic pathway herein, have not been produced from renewable sources and, as such, are new compositions of matter. These new bioproducts can be distinguished from organic compounds derived from petrochemical carbon on the basis of dual carbon-isotopic fingerprinting or $^{14}C$ dating. Additionally, the specific source of biosourced carbon (e.g., glucose vs. glycerol) can be determined by dual carbon-isotopic fingerprinting (see, e.g., U.S. Pat. No. 7,169,588). The ability to distinguish bioproducts from petroleum based organic compounds is beneficial in tracking these materials in commerce. For example, organic compounds or chemicals including both biologically based and petroleum based carbon isotope profiles may be distinguished from organic compounds and chemicals made only of petroleum based materials. Hence, the bioproducts herein can be followed or tracked in commerce on the basis of their unique carbon isotope profile. Bioproducts can be distinguished from petroleum based organic compounds by comparing the stable carbon isotope ratio ($^{13}C/^{12}C$) in each sample. The $^{13}C/^{12}C$ ratio in a given bioproduct is a consequence of the $^{13}C/^{12}C$ ratio in atmospheric carbon dioxide at the time the carbon dioxide is fixed. It also reflects the precise metabolic pathway. Regional variations also occur. Petroleum, C3 plants (the broadleaf), C4 plants (the grasses), and marine carbonates all show significant differences in $^{13}C/^{12}C$ and the corresponding $\delta^{13}C$ values. Furthermore, lipid matter of C3 and C4 plants analyze differently than materials derived from the carbohydrate components of the same plants as a consequence of the metabolic pathway. Within the precision of measurement, $^{13}C$ shows large variations due to isotopic fractionation effects, the most significant of which for bioproducts is the photosynthetic mechanism. The major cause of differences in the carbon isotope ratio in plants is closely associated with differences in the pathway of photosynthetic carbon metabolism in the plants, particularly the reaction occurring during the primary carboxylation (i.e., the initial fixation of atmospheric $CO_2$). Two large classes of vegetation are those that incorporate the C3 (or Calvin-Benson) photosynthetic cycle and those that incorporate the C4 (or Hatch-Slack) photosynthetic cycle. In C3 plants, the primary $CO_2$ fixation or carboxylation reaction involves the enzyme ribulose-1,5-diphosphate carboxylase, and the first stable product is a 3-carbon compound. C3 plants, such as hardwoods and conifers, are dominant in the temperate climate zones. In C4 plants, an additional carboxylation reaction involving another enzyme, phosphoenol-pyruvate carboxylase, is the primary carboxylation reaction. The first stable carbon compound is a 4-carbon acid that is subsequently decarboxylated. The $CO_2$ thus released is refixed by the C3 cycle. Examples of C4 plants are tropical grasses, corn, and sugar cane. Both C4 and C3 plants exhibit a range of $^{13}C/^{12}C$ isotopic ratios, but typical values are about −7 to about −13 per mil for C4 plants and about −19 to about −27 per mil for C3 plants (see, e.g., Stuiver et al. (1977) *Radiocarbon* 19:355). Coal and petroleum fall generally in this latter range. The $^{13}C$ measurement scale was originally defined by a zero set by Pee Dee Belemnite (PDB) limestone, where values are given in parts per thousand deviations from this material. The δ13C values are expressed in parts per thousand (per mil), abbreviated, ‰, and are calculated as follows:

$$\delta^{13}C(‰)=[(^{13}C/^{12}C)sample-(^{13}C/^{12}C)standard]/(^{13}C/^{12}C)standard \times 1000$$

Since the PDB reference material (RM) has been exhausted, a series of alternative RMs have been developed in cooperation with the IAEA, USGS, NIST, and other selected international isotope laboratories. Notations for the per mil deviations from PDB is $\delta^{13}C$. Measurements are made on $CO_2$ by high precision stable ratio mass spectrometry (IRMS) on molecular ions of masses 44, 45, and 46. The compositions described herein include bioproducts produced by any of the methods described herein, including, for example, fatty acid derivative products. Specifically, the bioproduct can have a $\delta^{13}C$ of about −28 or greater, about −27 or greater, −20 or greater, −18 or greater, −15 or greater, −13 or greater, −10 or greater, or −8 or greater. For example, the bioproduct can have a $\delta^{13}C$ of about −30 to about −15, about −27 to about −19, about −25 to about −21, about −15 to about −5, about −13 to about −7, or about −13 to about −10. In other instances, the bioproduct can have a $\delta^{13}C$ of about −10, −11, −12, or −12.3. Bioproducts produced in accordance with the disclosure herein, can also be distinguished from petroleum based organic compounds by comparing the amount of $^{14}C$ in each compound. Because $^{14}C$ has a nuclear half-life of 5730 years, petroleum based fuels containing older carbon can be distinguished from bioproducts which contain newer carbon (see, e.g., Currie, Source Apportionment of Atmospheric Particles, Characterization of Environmental Particles, J. Buffle and H. P. van Leeuwen, Eds., 1 of Vol. I of the IUPAC Environmental Analytical Chemistry Series (Lewis Publishers, Inc.) 3-74, (1992)). The basic assumption in radiocarbon dating is that the constancy of $^{14}C$ concentration in the atmosphere leads to the constancy of $^{14}C$ in living organisms. However, because of atmospheric nuclear testing since 1950 and the burning of fossil fuel since 1850, $^{14}C$ has acquired a second, geochemical time characteristic. Its concentration in atmospheric $CO_2$, and hence in the living biosphere, approximately doubled at the peak of nuclear testing, in the mid-1960s. It has since been gradually returning to the steady-state cosmogenic (atmospheric) baseline isotope rate ($^{14}C/^{12}C$) of about $1.2 \times 10^{-12}$, with an approximate relaxation "half-life" of 7-10 years. This latter half-life must not be taken literally; rather, one must use the detailed atmospheric nuclear input/decay function to trace the variation of atmospheric and biospheric $^{14}C$ since the onset of the nuclear age. It is this latter biospheric $^{14}C$ time characteristic that holds out the promise of annual dating of recent biospheric carbon. $^{14}C$ can be measured by accelerator mass spectrometry (AMS), with results given in units of fraction of modern carbon (fM). fM is defined by National Institute of Standards and Technology (NIST) Standard Reference Materials (SRMs) 4990B and 4990C. As used herein, fraction of modern carbon or fM has the same meaning as defined by National Institute of Standards and Technology (NIST) Standard Reference Materials (SRMs) 4990B and 4990C, known as oxalic acids standards HOxI and HOxII, respectively. The fundamental definition relates to 0.95 times the $^{14}C/^{12}C$ isotope ratio HOxI (referenced to AD 1950). This is roughly equivalent to decay-corrected pre-Industrial Revolution wood. For the current living biosphere (plant material), fM is approximately 1.1. The compositions described herein include bioproducts that can have an $fM^{14}C$ of at least about 1. For example, the bioproduct of the disclosure can have an $fM^{14}C$ of at least about 1.01, an $fM^{14}C$ of about 1 to about 1.5, an $fM^{14}C$ of about 1.04 to about 1.18, or an $fM^{14}C$ of about 1.111 to about 1.124.

Another measurement of $^{14}C$ is known as the percent of modern carbon (pMC). For an archaeologist or geologist using $^{14}C$ dates, AD 1950 equals zero years old. This also represents 100 pMC. Bomb carbon in the atmosphere reached almost twice the normal level in 1963 at the peak of thermo-nuclear weapons. Its distribution within the atmosphere has been approximated since its appearance, showing values that are greater than 100 pMC for plants and animals living since AD 1950. It has gradually decreased over time with today's value being near 107.5 pMC. This means that a fresh biomass material, such as corn, would give a $^{14}C$ signature near 107.5 pMC. Petroleum based compounds will have a pMC value of zero. Combining fossil carbon with present day carbon will result in a dilution of the present day pMC content. By presuming 107.5 pMC represents the $^{14}C$ content of present day biomass materials and 0 pMC represents the $^{14}C$ content of petroleum based products, the measured pMC value for that material will reflect the proportions of the two component types. For example, a material derived 100% from present day soybeans would give a radiocarbon signature near 107.5 pMC. If that material was diluted 50% with petroleum based products, it would give a radiocarbon signature of approximately 54 pMC. A biologically based carbon content is derived by assigning 100% equal to 107.5 pMC and 0% equal to 0 pMC. For example, a sample measuring 99 pMC will give an equivalent biologically based carbon content of 93%. This value is referred to as the mean biologically based carbon result and assumes all the components within the analyzed material originated either from present day biological material or petroleum based material. A bioproduct comprising one or more fatty acid derivatives as described herein can have a pMC of at least about 50, 60, 70, 75, 80, 85, 90, 95, 96, 97, 98, 99, or 100. In other instances, a fatty acid derivative described herein can have a pMC of between about 50 and about 100; about 60 and about 100; about 70 and about 100; about 80 and about 100; about 85 and about 100; about 87 and about 98; or about 90 and about 95. In yet other instances, a fatty acid derivative described herein can have a pMC of about 90, 91, 92, 93, 94, or 94.2.

EXAMPLES

The following specific examples are intended to illustrate the disclosure and should not be construed as limiting the scope of the claims.

Protocols and Methods

Screening a Library

All protocols described herein rely on a 96 well plate-master block-2 mL system (Greiner Bio-One, Monroe, N.C. or Corning, Amsterdam, The Netherlands) for growing cultures, and plates (Costar, Inc.) for extracting fatty acid species from the culture broth. The protocols provided below are examples of fermentation conditions. Alternative protocols can be used to evaluate fatty acid species production.

32° C. Plim Culture Protocol

30 µL LB culture (from an LB culture growing in a 96 well plate) was used to inoculate 290 µL Plim media (Table 2), which was then incubated for approximately 16 hours at 32° C. shaking. 40 µL of the overnight seed was used to inoculate 360 µL Plim media. After growing at 32° C. for 2 hours, the cultures were induced with IPTG (final concentration 1 mM) (Table 3 below). The cultures were then incubated at 32° C. with shaking for 20 hours if not noted otherwise, after which they were extracted following the standard extraction protocol detailed below.

35° C. Nlim Culture Protocol

40 µL LB culture (from an LB culture growing in a 96 well plate) was used to inoculate 360 µL LB media (Table 3 below), which was then incubated for approximately 4 hours at 32° C. shaking. 40 µL of the LB seed was used to inoculate 360 µL Nlim media. After growing at 32° C. for 2 hours at 35° C., the cultures were induced with IPTG (final concentration 1 mM) (Table 3 below). The cultures were then incubated at 35° C. with shaking for 20 hours if not noted otherwise, after which they were extracted following the standard extraction protocol detailed below.

TABLE 3

Media Names and Formulations

| Media Name | | | Formulation |
|---|---|---|---|
| Plim | 1 | x | 5x Plim Salt Soln. with $(NH_4)_2SO_4$ |
| | 1 | x | 1000x Trace Vitamins |
| | 1 | mg/L | 10 mg/mL Thiamine |
| | 1 | mM | 1M MgSO4 |
| | 0.1 | mM | 1M CaCl2 |
| | 40 | g/L | 500 g/L glucose |
| | 1 | x | 1000x Trace minerals |
| | 10 | mg/L | 10 g/L Fe Citrate |
| | 100 | µg/mL | 100 mg/ml spectinomycin |
| | 100 | mM | 2M BisTris (pH 7.0) |
| | 0.5 | mM | Aminolevulinic acid |
| Nlim | 1 | x | 5x Salt Soln. with NH4Cl |
| | 1 | x | 1000x Trace Vitamins |
| | 1 | mg/L | 10 mg/mL Thiamine |
| | 1 | mM | 1M MgSO4 |
| | 0.1 | mM | 1M CaCl2 |
| | 40 | g/L | 500 g/L glucose |
| | 1 | x | 1000x Trace minerals |
| | 10 | mg/L | 10 g/L Fe Citrate |
| | 100 | µg/mL | 100 mg/ml spectinomycin |
| | 100 | mM | 2M BisTris (pH 7.0) |
| | 0.5 | mM | Aminolevulinic acid |

Fatty Acid Species Standard Extraction Protocol

To each well to be extracted 80 µL of 1M HCl, followed by 400 µL of butyl acetate (with 500 mg/L pentadecanol as internal standard) was added. The 96 well plates were then heat-sealed using a plate sealer (ALPS-300 heater; Abgene, ThermoScientific, Rockford, Ill.), and shaken for 15 minutes at 2000 rpm using MIXMATE mixer (Eppendorf, Hamburg, Germany). After shaking, the plates were centrifuged for 10 minutes at 4500 rpm at room temperature (Allegra X-15R, rotor SX4750A, Beckman Coulter, Brea, Calif.) to separate the aqueous and organic layers. 100 µL of the organic layer was transferred to a 96 well plate (polypropylene, Corning, Amsterdam, The Netherlands) and derivatized with 100 uL of BSTFA. The plate was subsequently heat sealed and stored at −20° C. until evaluated by GC-FID using the ω-OH FFA method was carried out as follows: 1 µL of sample was injected onto an analytical column (DB-1, 10 m×180 µm×0.2 µM film thickness, available from JW 121-101A) in an Agilent 7890A GC Ultra device (Agilent, Santa Clara, Calif.) with a flame ionization detector (FID) with a 1-20 split. The instrument was set up to detect and quantify $C_{10}$ to $C_{18}$ fatty acids and ω-hydroxylated fatty acids. The protocol detailed above represents standard conditions, which may be modified as necessary to optimize the analytical results.

Building Error Prone Libraries

Standard techniques known to those of skill in the art were used to prepare error prone libraries. In one example, the vector backbone was prepared using restriction endonucleases in the vector, while the creation of diversity in the DNA insert was generated by PCR amplification from a DNA template under conditions favoring the incorporation of mismatched nucleotides. In one approach, the cloning of the vector backbone and a DNA insert with diversity was performed using the INFUSION Cloning System (Clontech Laboratories, Inc., Mountain View, Calif.), according to the manufacturer's protocol.

Building Saturation Libraries

Standard techniques known to those of skill in the art were used to prepare saturation libraries. In one example, the vector backbone was prepared using restriction endonucleases in the vector, while the creation of diversity in the DNA insert was generated using degenerate primers. In one approach, the cloning of the vector backbone and a DNA insert with diversity was performed using INFUSION Cloning System (Clontech Laboratories, Inc., Mountain View, Calif.) according to the manufacturer's protocol.

Building Combination Libraries

Mutations identified as beneficial were combined to provide CYP153-reductase hybrid fusion polypeptide variants (e.g., hybrid CYP153A-RedRhF protein variants) with further improvements in the production of ω-OH fatty acid derivative species. Standard techniques known to those of skill in the art were used to prepare the combination libraries. In one example, the vector backbone was prepared using restriction endonucleases in the vector, while the creation of diversity in the DNA insert was generated using primers to introduce the desired mutations. As described above, in one approach, the cloning of the vector backbone and a DNA insert with diversity was performed using INFUSION Cloning System (Clontech Laboratories, Inc., Mountain View, Calif.), according to manufacturer's protocol. Combination libraries can be generated using the transfer PCR (tPCR) protocol (Erijman et al. (2011) *J. Structural Bio.* 175:171-177).

Library Screening

Once the library diversity was generated in an error-prone, saturation library or combination library, it was screened using one of the methods described above. Two types of hits were identified: (1) increased amount of ω-hydroxy fatty acids ((ω-OH FFA titer); and/or (2) increased conversion of fatty acids to ω-hydroxy fatty acids. The mutations in the hybrid cyp153A-RedRhF protein variants within each hit were identified by sequencing, using standard techniques routinely employed by those of skill in the art. Tables 5, 6 and 7 below list the mutations (hits) identified as beneficial in saturation libraries.

Example 1: Strain and Plasmid Construction for Library Screening

This example describes the strains and plasmids constructed for saturation or combinatorial mutagenesis library screening.

A gene coding for a hybrid-fusion protein made of the CYP153A(G307A) P450 catalytic protein from *Marinobacter aquaeoli* and the c-terminal FMN- and Fe/S-containing reductase domain of P450RhF from *Rhodococcus* sp. NCIMB9784 was created as follows: The cyp165A(G307A)_Maqu gene was amplified from genomic DNA and fused with a codon-optimized synthetic P450RhF reductase domain by cross-over PCR. The resulting fusion gene (SEQ ID NO: 5) was cloned into a pACYC-derivative (i.e., p15A replicon, kanamycin resistance marker) such that its transcription was controlled by the IPTG-inducible Ptrc promoter. The plasmid was named pEP125 (see Table 4, infra).

The gene coding for the hybrid cyp153A(G307A)-Red450RhF fusion protein was also amplified from pEP125 and cloned into a pCL1920-derivative vector (SC101 replicon, spectinomycin resistance marker), such that its transcription was controlled by the IPTG-inducible Ptrc promoter and it formed an operon with genes coding for a plant thioesterase (fatB1), a variant of 3-keto-acyl-ACP synthase (fabB) and a transcriptional regulator (fadR). The plasmid was named pLC81 (see Table 4, infra).

Additional plasmids were created as follows: The gene coding a plant thioesterase (fatB1) from *Umbellularia californica* was synthesized as codon-optimized DNA and cloned into a pCL1920-derivative vector (SC101 replicon, spectinomycin resistance marker), such that its transcription was controlled by the IPTG-inducible Ptrc promoter and it formed an operon with genes coding for acetyl-CoA carboxylase (accDACB), biotin ligase (birA) and a acyl-carrier protein. The plasmid was named pNH305 (see Table 4, infra). Plasmid pAS033 was created by replacing fatB1 in pNH305 with a codon-optimized synthetic plant thioesterase (fatA3) from *Arabidopsis thaliana* (see Table 4, infra). Plasmid pEP146 was created by replacing fatB1 in pLC81 with a codon-optimized synthetic plant thioesterase (fatA3) from *Arabidopsis thaliana* (see Table 4, infra). pEP146 also carried a mutation in the plasmid encoded repA protein.

Base strains used for plasmid transformation were GLP077 and BZ128. Briefly, the genome of base strain GLPH077 was manipulated as follows: the acyl-CoA dehydrogenase (fadE) gene was deleted and a transcriptional regulator (fadR) and a synthetic fatty acid biosynthesis operon were overexpressed. Briefly, the genome of base strain BZ128 was manipulated as follows: the fadE (acyl-CoA dehydrogenase) gene was deleted and a synthetic fatty acid biosynthesis operon, a β-hydroxy fatty acyl-ACP dehydratase (fabZ) and a variant of a thioesterase (tesA) were overexpressed. In addition, the strain had previously been subjected to transposon as well as N-methyl-N'-nitro-N-nitrosoguanidine (NTG) mutagenesis and screening.

TABLE 4

Plasmids used for library screening

| Plasmid | Description |
|---|---|
| pAS033 | pCL-fatA3_Atal-accDCBAbirA_Cglu-acp_Ecol |
| pEP125 | pACYC-cyp153A(G307A)_Maqu-RedRhF_Rhod |
| pNH305 | pCL-fatB1_Ucal-accDCBAbirA_Cglu-acp_Ecol |
| pLC81 | pCL-cyp153A(G307A)_Maqu-RedRhF_Rhod-fatB1_Ucal-fadB_Ecol-fadR_Ecol |
| pEP146 | pCL*-cyp153A(G307A)_Maqu-RedRhF_Rhod-fatA3-Atal-fadB_Ecol-fadR_Ecol |

The hybrid cyp153A(G307A)-Red450RhF fusion protein was tested to see if expression in host cells could produce ω-OH fatty acid derivatives. A microorganism expressing SEQ ID NO: 5 was capable of producing over a 1 g/L of ω-OH fatty acid derivatives from glucose. Thus, this engineered enzyme was selected for further evolution studies.

Example 2: Saturation Libraries of the P450 Catalytic Domain of cyp153A(G307A)-Red450RhF Fusion Protein A full saturation library of the P450 catalytic domain of cyp153A-Red450RhF fusion protein, was built and screened for variants that showed improvements over cyp153A (G307A)-Red450RhF (i.e., the template polypeptide). G307A (i.e., an alanine residue replaced a glycine in position 307) is a beneficial mutation that improves ω-hydroxylase activity of cyp153A (see Honda Malca et al. (2012) *Chem. Commun.* 48:5115). The selection criteria for hits was (1)

increased amount of ω-hydroxy fatty acids (ωOH FFA titer); and/or (2) increased conversion of fatty acids to ω-hydroxy fatty acids.

Standard techniques known to those of skill in the art were used to prepare saturation libraries. Plasmids pEP125 and pLC81 (see Table 4, supra) were used to make the full saturation libraries. Three saturation libraries were screened: For the first library pEP125 was transformed together with pNH305 into strain GLPH077, for the second library pLC81 was transformed into BZ128, and for the third library pEP125 was transformed together with pAS.033 into GLPH077Strain. The $1^{st}$ and $2^{nd}$ library were screened in particular for improved variants in ω-hydroxy dodecanoic acid formation and the $3^{rd}$ library was screened in particular for improved variants in ω-hydroxy hexadecenoic acid formation. The libraries were screened using one of the standard protocols described above. The improved variants are shown in Tables 5 through 7 below (infra). In particular, variants of position 141 were identified multiple times and were found to be significantly improved enzymes both for ω-hydroxy dodecanoic acid and ω-hydroxy hexadecenoic acid formation.

TABLE 5

Summary of improved variants from $1^{st}$ site saturation library of the catalytic domain of cyp153A(G307A)-Red450RhF.

| ω-OH FFA | Total FAS | % ω-OH FFA | FIOC | % C12:0 ω-OH in C12:0 | FIOC | Amino Acids | Codons |
|---|---|---|---|---|---|---|---|
| 1346.3 | 2236.6 | 60.2 | 1.33 | 83.1 | 1.08 | V141Q | GTG/CAG |
| 1201.1 | 2149.3 | 55.9 | 1.23 | 84.1 | 1.10 | D134G | GAC/GGG |
| 1106.2 | 2006.9 | 55.1 | 1.22 | 82 | 1.07 | R40H | AGG/CAC |
| 1007.9 | 1839.7 | 54.8 | 1.21 | 86.1 | 1.12 | V141I | GTG/ATC |
| 962.5 | 1791.2 | 53.7 | 1.19 | 81.1 | 1.06 | K41V | AAG/GTG |
| 1228.6 | 2298.6 | 53.4 | 1.18 | 80.2 | 1.05 | M419V | ATG/GTC |
| 1046.8 | 1958.5 | 53.4 | 1.18 | 80.1 | 1.05 | VI54A | GTG/GCC |
| 990.7 | 1865.4 | 53.1 | 1.17 | 84.9 | 1.11 | D134G | GAC/GGT |
| 1203.1 | 2313.1 | 52 | 1.15 | 81.6 | 1.07 | D134G | GAC/GGG |
| 908.7 | 1773.2 | 51.2 | 1.13 | 80.3 | 1.05 | I11C | ATT/TGC |
| 1020.1 | 2057 | 49.6 | 1.09 | 81.4 | 1.06 | R205L | CGC/TTG |
| 1256 | 2688.4 | 46.7 | 1.03 | 72.6 | 0.95 | L304W | CTC/TGG |
| 883.2 | 1960.8 | 45.3 | 1.00 | 76.6 | 1.00 | | |

FIOC = Fold improvement over control; control is bold.

TABLE 6

Summary of improved variants from $2^{nd}$ site saturation library of the catalytic domain of cyp153A(G307A)-Red450RhF

| Mutation 1 | Mutation 2 | Total ω-OH FFA | Total FAS | % ω-OH FFA | FIOC | % C12:0 ω-OH in C12:0 FAS | FIOC |
|---|---|---|---|---|---|---|---|
| V415R | 0 | 928.10 | 2880.10 | 32.23 | 1.85 | 33.29 | 1.96 |
| V415R | 0 | 941.13 | 2980.97 | 31.58 | 1.81 | 32.98 | 1.94 |
| V154A | 0 | 694.63 | 2959.63 | 23.47 | 1.35 | 23.06 | 1.36 |
| V154A | 0 | 716.00 | 2963.77 | 24.16 | 1.39 | 23.88 | 1.40 |
| V154A | 0 | 686.93 | 2926.97 | 23.47 | 1.35 | 23.40 | 1.38 |
| V141M | E142Q | 717.80 | 2873.73 | 24.98 | 1.44 | 28.51 | 1.68 |
| V141I | 0 | 749.07 | 2971.23 | 25.21 | 1.45 | 31.96 | 1.88 |
| V141I | 0 | 778.87 | 2886.77 | 26.98 | 1.55 | 34.27 | 2.02 |
| V141I | 0 | 754.67 | 2918.90 | 25.85 | 1.49 | 32.85 | 1.93 |
| V141I | R258Y | 672.13 | 2909.13 | 23.10 | 1.33 | 29.24 | 1.72 |
| V141I | 0 | 810.23 | 2912.67 | 27.83 | 1.60 | 35.86 | 2.11 |
| S233R | 0 | 720.13 | 2838.00 | 25.37 | 1.46 | 30.82 | 1.81 |
| S233R | 0 | 746.20 | 2912.97 | 25.61 | 1.47 | 31.15 | 1.83 |
| S233N | 0 | 735.57 | 2905.40 | 25.33 | 1.46 | 25.77 | 1.52 |
| S233N | 0 | 698.80 | 2915.17 | 23.97 | 1.38 | 24.40 | 1.44 |
| S233N | 0 | 732.47 | 2949.93 | 24.83 | 1.43 | 25.29 | 1.49 |
| S233N | 0 | 725.97 | 3018.60 | 24.05 | 1.38 | 24.76 | 1.46 |
| R82D | E271F | 629.03 | 2914.83 | 21.58 | 1.24 | 20.90 | 1.23 |
| R6F | R178N | 792.33 | 2845.17 | 27.85 | 1.60 | 28.56 | 1.68 |
| R6F | V141I | 833.13 | 2871.87 | 29.01 | 1.67 | 36.28 | 2.13 |
| R27L | 0 | 742.57 | 2857.53 | 25.99 | 1.49 | 26.10 | 1.54 |
| R178N | 0 | 701.17 | 2983.60 | 23.50 | 1.35 | 24.98 | 1.47 |
| Q129R | 0 | 675.07 | 2847.37 | 23.71 | 1.36 | 27.97 | 1.65 |
| Q129R | 0 | 812.23 | 3044.30 | 26.68 | 1.53 | 31.29 | 1.84 |
| Q129R | 0 | 660.53 | 2967.23 | 22.26 | 1.28 | 26.24 | 1.54 |
| P149R | S157V | 684.03 | 3011.80 | 22.71 | 1.31 | 23.04 | 1.36 |
| P149R | 0 | 771.40 | 2959.70 | 26.06 | 1.50 | 26.12 | 1.54 |
| P149R | 0 | 731.10 | 2966.13 | 24.65 | 1.42 | 24.75 | 1.46 |
| P149R | 0 | 757.97 | 3014.93 | 25.14 | 1.45 | 25.49 | 1.50 |
| P149R | 0 | 765.90 | 2963.50 | 25.84 | 1.49 | 26.16 | 1.54 |
| P149R | 0 | 734.30 | 2923.70 | 25.12 | 1.44 | 25.50 | 1.50 |
| P149R | 0 | 745.00 | 2993.83 | 24.88 | 1.43 | 25.47 | 1.50 |
| P136T | 0 | 724.53 | 2980.20 | 24.31 | 1.40 | 24.97 | 1.47 |

TABLE 6-continued

Summary of improved variants from 2$^{nd}$ site saturation library of the catalytic domain of cyp153A(G307A)-Red450RhF

| Mutation 1 | Mutation 2 | Total ω-OH FFA | Total FAS | % ω-OH FFA | FIOC | % C12:0 ω-OH in C12:0 FAS | FIOC |
|---|---|---|---|---|---|---|---|
| P136T | 0 | 729.37 | 3017.67 | 24.17 | 1.39 | 24.90 | 1.46 |
| P136T | 0 | 678.33 | 2850.87 | 23.79 | 1.37 | 24.39 | 1.43 |
| P136C | 0 | 702.27 | 2947.23 | 23.83 | 1.37 | 25.36 | 1.49 |
| P136C | 0 | 689.77 | 3069.63 | 22.47 | 1.29 | 24.01 | 1.41 |
| N407A | 0 | 731.50 | 3042.77 | 24.04 | 1.38 | 24.56 | 1.44 |
| N407A | 0 | 704.47 | 3015.93 | 23.36 | 1.34 | 23.75 | 1.40 |
| M228R | 0 | 344.60 | 2992.27 | 11.52 | 0.66 | 18.33 | 1.08 |
| L168V | 0 | 793.20 | 2938.23 | 27.00 | 1.55 | 27.84 | 1.64 |
| G161P | 0 | 718.33 | 2938.47 | 24.45 | 1.41 | 24.28 | 1.43 |
| G161A | 0 | 639.93 | 2943.40 | 21.74 | 1.25 | 21.65 | 1.27 |
| G138F | N407A | 667.93 | 2825.43 | 23.64 | 1.36 | 26.09 | 1.53 |
| F116R | V415R | 678.77 | 2854.97 | 23.78 | 1.37 | 24.14 | 1.42 |
| E142R | 0 | 663.67 | 2925.83 | 22.68 | 1.30 | 22.86 | 1.34 |
| E142R | 0 | 628.03 | 2930.57 | 21.43 | 1.23 | 21.62 | 1.27 |
| E142R | 0 | 639.23 | 2972.03 | 21.51 | 1.24 | 21.86 | 1.29 |
| D153G | 0 | 787.87 | 3018.90 | 26.13 | 1.50 | 26.94 | 1.58 |
| D153G | 0 | 746.20 | 3039.10 | 24.55 | 1.41 | 25.31 | 1.49 |
| 0 | 0 | 543.65 | 3117.75 | 17.44 | 1.00 | 17.04 | 1.00 |

FIOC = Fold improvement over control; control is bold.

TABLE 7

Summary of improved variants from 3$^{rd}$ site saturation library of the catalytic domain of cyp153A(G307A)-Red450RhF

| ω-OH FFA | Total FAS | % ω-OH FFA | FIOC | % C16:0 ω-OH in C16:0 | FIOC | % C16:1 ω-OH in C16:1 | FIOC | Amino Acids | Codons |
|---|---|---|---|---|---|---|---|---|---|
| 1298.5 | 2342.5 | 55.43 | 1.53 | 64.61 | 1.33 | 49.02 | 2.00 | N309R | AAC/CGG |
| 1095.9 | 2374.3 | 46.16 | 1.28 | 58.36 | 1.20 | 34.41 | 1.40 | V141G | GTG/GGG |
| 1564 | 3448.1 | 45.36 | 1.25 | 62.78 | 1.29 | 32.88 | 1.34 | L132T | CTC/ACT |
| 1092.9 | 2391.4 | 45.70 | 1.26 | 60.82 | 1.25 | 32.96 | 1.34 | F144R | TTC/AGG |
| 1170.5 | 2529.6 | 46.27 | 1.28 | 62.41 | 1.28 | 31.91 | 1.30 | I131L | ATT/TTG |
| 1232.9 | 2685.8 | 45.90 | 1.27 | 55.17 | 1.13 | 37.63 | 1.53 | G308W | GGC/TGG |
| 931.1 | 2570.1 | 36.2 | 1.00 | 48.70 | 1.00 | 24.53 | 1.00 | | |

FIOC = Fold improvement over control; control is bold.

Example 3: Partial Site Saturation Libraries of the Reductase Domain of cyp153A(G307A)-Red450RhF Fusion Protein A partial saturation library (every 10$^{th}$ amino acid was mutated) of the reductase domains of hybrid cyp153A-Red450RhF fusion protein, was built and screened for variants that showed improvements over cyp153A(V141I, A231T, G307A)-Red450RhF (SEQ ID NO: 32), a variant identified in the site saturation mutagenesis library of the catalytic P450 cyp153A domain. The selection criteria for hits was (1) increased amount of ω-hydroxy dodecanoic acid (ωOH FFA titer); and/or (2) increased conversion of dodecanoic acid to ω-hydroxy dodecanoic acid.

Standard techniques known to those of skill in the art were used to prepare saturation libraries. For the library, pLC81 harboring cyp153A(V141I, A231T, G307A)-Red450RhF was transformed into BZ128. The library was screened using one of the standard protocols described above. The improved variants are shown in Table 8. In particular the variants A796V (SEQ ID: 42) and P666A were significantly improved enzymes.

TABLE 8

Summary of improved variants from a partial saturation library of the reductase domain of cyp153A(V141I A231T G307A)-Red450RhF

| RhF Mutation | ω-OH FFA | FAS | % ω-OH FFA | FIOC | C12:0 ω-OH in C12:0 FAS | FIOC |
|---|---|---|---|---|---|---|
| P666K | 1012.1 | 2945.5 | 34.36 | 1.09 | 44.08 | 1.07 |
| P666A | 1575.9 | 2918.7 | 53.99 | 1.71 | 68.35 | 1.66 |
| T516E | 1150.4 | 2966.2 | 38.78 | 1.23 | 49.01 | 1.19 |
| V696K | 983.4 | 2955.4 | 33.27 | 1.05 | 43.02 | 1.05 |
| 0 | 950.3 | 3004.6 | 31.63 | 1.00 | 41.13 | 1.00 |
| A796V | 2458.0 | 3884.7 | 63.27 | 1.81 | 76.58 | 1.70 |
| 0 | 1363.7 | 3905.2 | 34.92 | 1.00 | 44.96 | 1.00 |

FIOC = Fold improvement over control; control is bold.

Example 4: Combinatorial Library of the Reductase Domain of cyp153A(G307A)-Red450RhF Fusion Protein Beneficial mutations identified in the partial saturation library of the reductase domain (Example 3) were the basis of a combination library to further improve cyp153A (G307A)-Red450RhF fusion protein. The selection criteria was (1) increased amount of ω-hydroxy dodecanoic acid (ωOH FFA titer); and/or (2) increased conversion of dodecanoic acid to ω-hydroxy dodecanoic acid.

The combination library was constructed in pLC81 harboring cyp153A(V141I, A231T, G307A)-Red450RhF (SEQ ID: 32) and transformed into BZ128. Standard techniques known to those of skill in the art were used to prepare combination libraries. The library was screened using one of the standard protocols described above. The improved variants are shown in Table 9 below.

TABLE 9

Summary of improved variants from a combination library of the reductase domain of cyp153A(V141I, A231T, G307A)-Red450RhF

| P450 Mutation | RhF Mutation | ω-OH FFA | FAS | % ω-OH FFA | FIOC | %C 12:0 ω-OH in C12:0FAS | FIOC |
|---|---|---|---|---|---|---|---|
| 141I, 231T | T516G, P666M, A769V | 851 | 983 | 86.8 | 1.29 | 88.3 | 1.23 |
| 141I, 231T | T516G, P666H, A769V | 1557 | 2214 | 69.2 | 1.03 | 73.1 | 1.02 |
| 141I, 231T | T516V, P666D, A769V | 1491 | 1999 | 74.5 | 1.11 | 76.9 | 1.07 |
| 141I, 231T | P666M, V696T | 916.88 | 1125 | 81.4 | 1.21 | 82.9 | 1.15 |
| 141I, 231T | A769V | 1528.33 | 2280 | 67.1 | 1.00 | 71.8 | 1.00 |

FIOC = Fold improvement over control; control is bold.

Example 5: Combinatorial Library of the Catalytic and Reductase Domain of cyp153A(G307A)-Red450RhF Fusion Protein Beneficial mutations identified in the saturation libraries (Example 2 and 3) were the basis of a combination library to further improve cyp153A(G307A)-Red450RhF fusion protein. The selection criteria was (1) increased amount of ω-hydroxy dodecanoic acid (ωOH FFA titer); and/or (2) increased conversion of dodecanoic acid to ω-hydroxy dodecanoic acid. The combination library was constructed in pLC81 and transformed into BZ128. Standard techniques known to those of skill in the art were used to prepare combination libraries. The library was screened using one of the standard protocols described above. The best two improved variants are shown in Table 10.

TABLE 10

Best improved variants from a combinatorial library of cyp153A(G307A)-Red450RhF

| Mutations | SEQ ID NO | ω-OH FFA* | FAS* | ω-OH FFA | C12:0 ω-OH in C12:0 FAS |
|---|---|---|---|---|---|
| R27l, R82D, V141M, R178N, N407A | 34 | 2290.3 | 3665.1 | 62.4% | 74.1% |
| R27l, R82D, V141M, R178N, N407A, A796V | 44 | 3499.5 | 4154.9 | 84.5% | 93.1% |

*Titer (mg/L) after 48 h

Example 6: Site Saturation Mutagenesis of the Position 141 and 309 of cyp153A(G307A, A796V)-Red450RhF It was noticed that changes in position 141 influenced substrate specificity. Therefore, a site saturation mutagenesis of these two positions were carried out in cyp153A(G307A, A796V)-Red450RhF. The selection criteria for hits was (1) increased amount of ω-hydroxy hexadecenoic acid; and/or (2) increased conversion of hexadecenoic acid to ω-hydroxy hexadecenoic acid.

Figure 2:
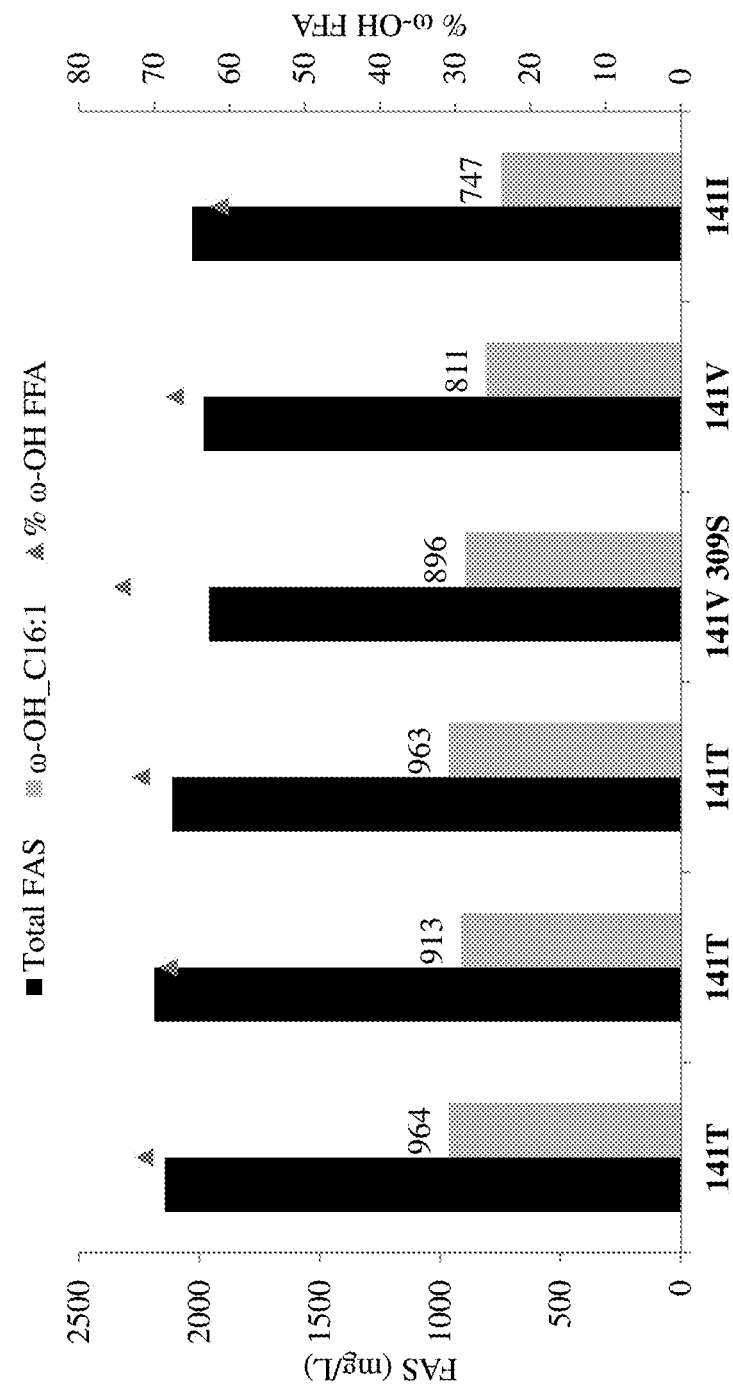
FIG. 2 provides an example of the production of ω-hydroxylated fatty acids as a result of expression of a CYP153A-reductase hybrid fusion polypeptide variant. In order to illustrate the production of ω-hydroxylated (ω-OH) fatty acids through variants a site saturation mutagenesis was employed. The depicted graph shows the best hits from a site saturation mutagenesis of the amino acid position 141 and 309 of CYP153A(G307A, A796V)-Red450RhF. The figure refers to total fatty acid species (total FAS) (see dark-gray bar); to ω-hydroxy hexadecenoic acid (ω-OH $C_{16:1}$) (see light-gray bar); and percent ω-hydroxy fatty acids (% ω-OH FFA) (see arrow).

For the library, pEP146 harboring cyp153A(G307A A796V)-Red450RhF (SEQ ID: 38) was transformed into BZ128. Standard techniques known to those of skill in the art were used to prepare site saturation libraries. The library was screened using one of the standard protocols described above. The improved variants are shown in FIG. 2. In particular, the variants with V141T (SEQ ID: 46) showed highest ω-hydroxy hexadecenoic acid titer and highest conversion from hexadecenoic acid.

Example 7: Saturation Libraries of cyp153A(G307A)-Red450RhF(A796V) Fusion Protein A full saturation library of cyp153A-Red450RhF fusion protein, was built and screened for variants that showed improvements over cyp153A(G307A)-Red450RhF(A796V) (i.e., the template variant, SEQ ID NO: 38). G307A (i.e., an alanine residue replaced a glycine in position 307) and A796V (i.e., a valine residue replaced an alanine in position 796) are beneficial mutations that improve ω-hydroxylase activity of cyp153A (see above). The selection criteria for hits was (1) an increased amount of ω-hydroxy fatty acids (ω-OH FFA titer); and/or (2) increased conversion of fatty acids to ω-hydroxy fatty acids.

Standard techniques known to those of skill in the art were used to prepare the saturation library. Plasmid pEP302 was used to make the full saturation library, which was a derivative of pEP146 (see Table 4), in which the order of the genes was altered (fatA3-fadB-fadR-cyp153A(G307A)-Red450RhF(A796V)) and the last gene was expressed from a separate promoter. The library was transformed into strain stNH1525. Briefly, the genome of base strain stNH1525 was manipulated as follows: the fadE (acyl-CoA dehydrogenase) gene was deleted and a synthetic fatty acid biosynthesis operon was overexpressed. In addition, the strain had previously been subjected to transposon as well as N-methyl-N'-nitro-N-nitrosoguanidine (NTG) mutagenesis and screening.

The libraries were screened using one of the standard protocols described above. The improved variants are shown in Table 11 below, in particular, variants that significantly improved ω-hydroxy hexadecanoic acid and ω-hydroxy hexadecenoic acid formation.

TABLE 11

Summary of improved variants from the site saturation library of cyp153A(G307A)-Red450RhF(A976V)

| w-OH FFA | Total FAS | % w-OH FFA | FOIC | % C16:1 w-OH in C16:1 | FOIC | % C16:0 w-OH in C16:0 | FOIC | Amino acids | Codons |
|---|---|---|---|---|---|---|---|---|---|
| 1201.0 | 1751.4 | 68.6 | 1.8 | 59.7 | 2.1 | 80.1 | 1.4 | D747N | AAC |
| 1007.7 | 1733.3 | 58.1 | 1.6 | 50.6 | 1.9 | 79.0 | 1.4 | Q12W | TGG |
| 793.2 | 1366.8 | 58.0 | 1.6 | 54.4 | 2.0 | 77.1 | 1.3 | P327D | GAT |
| 955.6 | 1714.9 | 55.7 | 1.5 | 50.6 | 1.7 | 74.9 | 1.3 | RUF | TTC |
| 678.7 | 1235.6 | 54.9 | 1.4 | 52.6 | 1.8 | 73.1 | 1.3 | N61L | TTG |
| 855.8 | 1629.3 | 52.5 | 1.4 | 44.6 | 1.6 | 72.9 | 1.3 | R27L | TTG |
| 911.6 | 1763.5 | 51.7 | 1.4 | 44.7 | 1.6 | 72.3 | 1.2 | Q28M | ATG |
| 858.1 | 1678.7 | 51.1 | 1.3 | 46.8 | 1.6 | 69.9 | 1.2 | S13K | AAG |
| 1247.9 | 2458.5 | 50.8 | 1.3 | 44.3 | 1.6 | 67.8 | 1.2 | V771F | TTC |
| 850.2 | 1686.3 | 50.4 | 1.3 | 42.1 | 1.5 | 71.6 | 1.2 | Q12T | ACG |
| 810.3 | 1615.4 | 50.2 | 1.3 | 46.8 | 1.6 | 65.0 | 1.1 | K119R | CGG |
| 821.1 | 1639.9 | 50.1 | 1.3 | 43.7 | 1.6 | 70.1 | 1.2 | D10Y | TAC |
| 807.4 | 1676.8 | 48.2 | 1.3 | 40.8 | 1.4 | 68.7 | 1.2 | Q12R | AGG |
| 722.5 | 1519.4 | 47.6 | 1.3 | 39.3 | 1.4 | 68.9 | 1.2 | I11L | TTG |
| 748.9 | 1576.6 | 47.5 | 1.2 | 42.4 | 1.5 | 66.3 | 1.1 | Q28T | ACG |
| 733.8 | 1546.2 | 47.5 | 1.3 | 38.7 | 1.4 | 68.9 | 1.2 | A231Y | TAC |
| 1198.9 | 2528.5 | 47.4 | 1.2 | 39.9 | 1.4 | 67.5 | 1.2 | P745R | CGC/CGG |
| 769.8 | 1647.1 | 46.7 | 1.2 | 38.1 | 1.4 | 68.0 | 1.2 | D9N | AAT |
| 1133.4 | 2469.6 | 45.9 | 1.2 | 38.1 | 1.4 | 65.6 | 1.1 | T770G | GGT |
| 763.7 | 1672.4 | 45.7 | 1.2 | 39.0 | 1.4 | 63.2 | 1.1 | Y413R | AGG |
| 1146.2 | 2514.4 | 45.6 | 1.2 | 37.0 | 1.3 | 66.0 | 1.1 | M784I | ATC |
| 729.8 | 1610.4 | 45.3 | 1.2 | 36.5 | 1.3 | 65.8 | 1.1 | D9K | AAG |
| 1078.0 | 2390.8 | 45.1 | 1.2 | 35.7 | 1.3 | 66.7 | 1.1 | E749L | TTG |
| 752.9 | 1682.8 | 44.7 | 1.2 | 38.1 | 1.3 | 63.7 | 1.1 | S233L | TTG |
| 940.3 | 2111.2 | 44.5 | 1.2 | 35.9 | 1.3 | 65.4 | 1.1 | E757A | GCG |
| 1063.1 | 2405.5 | 44.2 | 1.2 | 35.5 | 1.3 | 65.0 | 1.1 | L703G | GGG |
| 632.5 | 1434.9 | 44.1 | 1.2 | 37.5 | 1.3 | 61.5 | 1.1 | N309S | TCT |
| 755.7 | 1715.3 | 44.1 | 1.2 | 35.0 | 1.3 | 64.5 | 1.1 | S140N | AAC |
| 1070.7 | 2441.3 | 43.9 | 1.2 | 37.6 | 1.3 | 60.9 | 1.0 | L706E | GAG |
| 757.3 | 1753.4 | 43.2 | 1.2 | 33.7 | 1.2 | 65.2 | 1.1 | I480G | GGT |
| 880.6 | 2044.0 | 43.1 | 1.2 | 33.6 | 1.2 | 65.3 | 1.1 | G481I | ATT |
| 989.8 | 2301.4 | 43.0 | 1.1 | 35.0 | 1.2 | 62.5 | 1.1 | R719W | TGG |
| 1062.9 | 2478.7 | 42.9 | 1.1 | 35.7 | 1.3 | 61.1 | 1.0 | L706S | TCG |
| 906.2 | 2116.3 | 42.8 | 1.1 | 34.8 | 1.3 | 62.5 | 1.1 | E557W | TGG |
| 734.0 | 1717.3 | 42.7 | 1.1 | 34.1 | 1.3 | 60.6 | 1.0 | S157R | CGG |
| 651.4 | 1527.0 | 42.7 | 1.1 | 35.9 | 1.2 | 61.1 | 1.1 | S233V | GTC |
| 710.4 | 1667.8 | 42.6 | 1.1 | 35.6 | 1.2 | 60.6 | 1.0 | A231V | GTA |
| 663.4 | 1558.7 | 42.6 | 1.1 | 33.4 | 1.1 | 62.1 | 1.1 | A164N | AAC |
| 664.3 | 1564.2 | 42.5 | 1.1 | 32.3 | 1.2 | 64.7 | 1.1 | A244R | CGG |
| 711.2 | 1675.3 | 42.5 | 1.1 | 38.3 | 1.3 | 56.0 | 1.0 | T302M | ATG |
| 1010.3 | 2381.5 | 42.4 | 1.1 | 34.1 | 1.2 | 62.4 | 1.1 | P708S | TCG |
| 1015.6 | 2394.2 | 42.4 | 1.1 | 32.3 | 1.1 | 64.9 | 1.1 | N741G | GGG |
| 690.6 | 1630.5 | 42.4 | 1.1 | 33.3 | 1.2 | 63.0 | 1.1 | P149G | GGG |
| 656.9 | 1552.9 | 42.3 | 1.1 | 34.8 | 1.3 | 60.9 | 1.0 | V154G | GGC |
| 905.2 | 2139.9 | 42.3 | 1.1 | 33.1 | 1.2 | 63.6 | 1.1 | E557R | CGG/AGG |
| 946.6 | 2247.5 | 42.1 | 1.1 | 32.9 | 1.2 | 63.4 | 1.1 | V710Q | CAG |
| 1159.1 | 2753.7 | 42.1 | 1.1 | 32.6 | 1.2 | 65.7 | 1.1 | E567S | TCC |
| 640.8 | 1522.8 | 42.1 | 1.1 | 34.4 | 1.3 | 59.7 | 1.0 | P149R | AGG |
| 665.7 | 1587.4 | 41.9 | 1.1 | 33.0 | 1.2 | 61.8 | 1.1 | N407G | GGG |
| 1026.9 | 2465.0 | 41.7 | 1.1 | 31.7 | 1.1 | 63.9 | 1.1 | D544N | AAC |
| 941.4 | 2265.1 | 41.6 | 1.1 | 32.5 | 1.2 | 62.6 | 1.1 | D709L | CTG |
| 721.3 | 1747.4 | 41.3 | 1.1 | 35.1 | 1.2 | 58.3 | 1.0 | G204V | GTT |
| 985.6 | 2393.7 | 41.2 | 1.1 | 31.7 | 1.1 | 62.7 | 1.1 | V710C | TGT |
| 696.6 | 1694.0 | 41.1 | 1.1 | 32.3 | 1.2 | 61.5 | 1.1 | R254G | GGG |
| 664.3 | 1616.1 | 41.1 | 1.1 | 32.8 | 1.1 | 61.1 | 1.1 | P273M | ATG |
| 739.2 | 1801.0 | 41.0 | 1.1 | 33.8 | 1.2 | 59.9 | 1.0 | F111A | GCG |
| 1042.8 | 2540.9 | 41.0 | 1.1 | 31.6 | 1.1 | 62.5 | 1.1 | E749M | ATG |
| 681.8 | 1661.6 | 41.0 | 1.1 | 30.0 | 1.1 | 64.3 | 1.1 | A231W | TGG |
| 1017.8 | 2487.3 | 40.9 | 1.1 | 31.1 | 1.1 | 63.2 | 1.1 | P546G | GGG |
| 719.6 | 1760.1 | 40.9 | 1.1 | 32.2 | 1.2 | 60.4 | 1.0 | V162C | TGC |
| 950.8 | 2327.9 | 40.8 | 1.1 | 31.8 | 1.1 | 61.8 | 1.1 | A736V | GTC |
| 945.2 | 2314.2 | 40.8 | 1.1 | 34.2 | 1.2 | 58.5 | 1.0 | L706H | CAC |
| 914.2 | 2241.1 | 40.8 | 1.1 | 31.4 | 1.1 | 62.3 | 1.1 | V710R | AGG |
| 1055.3 | 2587.4 | 40.8 | 1.1 | 32.0 | 1.1 | 61.2 | 1.0 | D707E | GAG |
| 883.4 | 2168.3 | 40.7 | 1.1 | 32.5 | 1.2 | 60.7 | 1.0 | D527E | GAG |
| 921.4 | 2266.5 | 40.7 | 1.1 | 32.9 | 1.2 | 60.3 | 1.0 | P745K | AAG |
| 728.9 | 1804.5 | 40.4 | 1.1 | 32.2 | 1.1 | 60.3 | 1.0 | E271D | GAC |
| 1031.5 | 2558.2 | 40.3 | 1.1 | 30.2 | 1.1 | 62.2 | 1.1 | E557R | AGG |
| 974.6 | 2429.2 | 40.1 | 1.1 | 30.6 | 1.1 | 61.8 | 1.1 | D720V | GTG |
| 647.6 | 1616.5 | 40.1 | 1.1 | 30.2 | 1.1 | 61.2 | 1.1 | P56Q | CAG |
| 934.9 | 2358.1 | 39.6 | 1.1 | 30.6 | 1.1 | 61.5 | 1.1 | V648L | TTG |
| 938.8 | 2376.0 | 39.5 | 1.1 | 32.0 | 1.1 | 58.6 | 1.0 | S649I | ATC |
| 672.1 | 1709.2 | 39.3 | 1.1 | 30.5 | 1.1 | 59.7 | 1.0 | P477G | GGG |

TABLE 11-continued

Summary of improved variants from the site saturation library of cyp153A(G307A)-Red450RhF(A976V)

| ω-OH FFA | Total FAS | % ω-OH FFA | FOIC | % C16:1 ω-OH in C16:1 | FOIC | % C16:0 ω-OH in C16:0 | FOIC | Amino acids | Codons |
|---|---|---|---|---|---|---|---|---|---|
| 878.5 | 2245.0 | 39.1 | 1.1 | 30.2 | 1.1 | 60.1 | 1.1 | E591Q | CAG |
| 598.2 | 1582.9 | 37.8 | 1 | 28.4 | 1.0 | 57.8 | 1.0 | | |

FOIC = Fold improvement over internal control; control is bold.

Example 8: Combinatorial Library of the Catalytic Domain of cyp153A(G307A)-Red450RhF(A796V) Fusion Protein Beneficial mutations identified in the saturation library of the catalytic domain (Example 7) were the basis of a combination library to further improve cyp153A(G307A)-Red450RhF(A796V) fusion protein. The selection criteria for hits was (1) an increased amount of ω-hydroxy fatty acids (ω-OH FFA titer); and/or (2) increased conversion of fatty acids to ω-hydroxy fatty acids.

The combination library was constructed in pEP302 harboring cyp153A(G307A)-Red450RhF (A796A) (SEQ ID: 38) and transformed into stNH1525. Standard techniques known to those of skill in the art were used to prepare combination libraries. The library was screened using one of the standard protocols described above. The improved variants are shown in Table 12 below, in particular, variants that significantly improved ω-hydroxy fatty acid formation.

TABLE 12

Summary of improved variants from a combination library of the catalytic domain of cyp153A(G307A)-Red450RhF(A796V) (SEQ ID NO: 38)

| P450 mutation | SEQ ID | ω-OH FFA | FAS | % ω-OH FFA | FOIC |
|---|---|---|---|---|---|
| Q12W, R27L, K119R, S140N, S157R, V159M, S233L, A244R | 98 | 1197.3 | 1610.1 | 74.4 | 3.3 |
| Q12R, Q28M, N61L, K119R, A231V, N309S, Y413R, I480G | 100 | 1227.6 | 1748.6 | 70.2 | 3.1 |
| Q12R, K119R, A231V, I480G | 102 | 1156.0 | 1699.8 | 68.0 | 3.0 |
| Q12T, Q28M, R77Q, K119R, V141T, A231W, N407G | 104 | 1204.3 | 1929.1 | 62.4 | 2.8 |
| Q12R, Q28M, N61L, V141T, A231Y, N407G | 106 | 1153.2 | 1909.9 | 60.4 | 2.7 |
| Q12W, Q28M, K119R, A231Y, A244R | 108 | 1007.9 | 1637.8 | 61.5 | 2.7 |
| Q12W, Q28T, N407G, I480G | 110 | 904.0 | 1478.9 | 61.1 | 2.7 |
| Q12R, V141T, A231Y, Y413R, G481I | 112 | 1043.2 | 1733.6 | 60.2 | 2.7 |
| Q12T, Q28M, F111A, A231V, N407G | 114 | 1029.3 | 1713.8 | 60.1 | 2.6 |
| Q12T, Q28M, N61L, S140N, P149R | 116 | 890.9 | 1536.8 | 58.0 | 2.6 |
| Control: SEQ ID NO: 38 | 38 | 427.8 | 1889.1 | 22.7 | 1.0 |

FOIC: Fold improvement over control; control is bold

Example 9: Combinatorial Library of the Catalytic Domain of cyp153A(G307A)-Red450RhF(A796V) Fusion Protein at High Expression Level Beneficial mutations identified in the combinatorial library of the catalytic domain (see Example 8, supra) were the basis for the next round of a combination library to further improve the cyp153A(G307A)-Red450RhF(A796V) fusion protein. The selection criteria for hits was (1) an increased amount of ω-hydroxy fatty acids (ω-OH FFA titer); and/or (2) increased conversion of fatty acids to ω-hydroxy fatty acids.

The combination library was constructed in pAA.016 plasmid, a derivative of pEP302, harboring cyp153A (G307A)-Red450RhF (A796A) (SEQ ID: 38) at a higher expression level and transformed into stNH1525. Standard techniques known to those of skill in the art were used to prepare the combination library. The library was screened using one of the standard protocols described above. The improved variants are shown in Table 13 below, in particular, variants that significantly improved ω-hydroxy fatty acid formation.

TABLE 13

Summary of improved variants at higher expression level from a combination library of the catalytic domain of cyp153A(G307A)-Red450RhF(A796V)

| P450 mutations | SEQ ID | ω-OH FFA | FAS | % ω-OH FFA | FOIC |
|---|---|---|---|---|---|
| Q12W, Q28T, R77Q, K119R, V159M, A231Y, R254G, N407G, I480G | 118 | 471.5 | 573.9 | 82.2 | 1.5 |
| Q12W, Q28T, R254G, N309S, N407G, V451M | 120 | 468.8 | 598.8 | 78.5 | 1.4 |
| Q12W, Q28T, R254G, N309S, N407G, I480G | 122 | 426.6 | 546.6 | 78.1 | 1.4 |
| Q12W, Q28T, N309S, N407G, V451M, I480G | 124 | 404.5 | 526.1 | 76.9 | 1.4 |
| Control: SEQ ID NO: 38 | 38 | 279.0 | 503.9 | 55.4 | 1.0 |

FOIC: Fold improvement over control; control is bold

Example 10: Combinatorial Library of the Reductase Domain of cyp153A(G307A)-Red450RhF(A796V) Fusion Protein Beneficial mutations identified in the saturation library of the reductase domain (Example 7) were the basis of a combination library to further improve the cyp153A (G307A)-Red450RhF(A796V) fusion protein. The selection criteria was (1) an increased amount of ω-hydroxy fatty acids (ω-OH FFA titer); and/or (2) increased conversion of fatty acids to ω-hydroxy fatty acids.

The combination library was constructed in pEP302 and transformed into stNH1525. Standard techniques known to those of skill in the art were used to prepare combination libraries. The library was screened using one of the standard protocols described above. The improved variants are shown in Table 14.

TABLE 14

Improved variants from a combinatorial library of the reductase domain of cyp153A(G307A)-Red450RhF(A796V)

| RhF domain mutation | SEQ ID | ω-OH FFA | FAS | % ω-OH FFA | FOIC |
|---|---|---|---|---|---|
| D527E, D544N, R719W, E757A, V771F, M784I | 126 | 1223.3 | 2222.6 | 55.0 | 2.1 |
| D527E, D544N, E557R | 128 | 1167.3 | 2197.3 | 53.1 | 2.0 |
| T770G, M784I | 130 | 1083.0 | 2084.5 | 52.0 | 2.0 |
| D527E, E591Q, V648L, R719W, E757A, V771F, M784I | 132 | 1191.5 | 2264.0 | 52.6 | 1.9 |
| D527E, E591Q, V648L, E757A, V771F | 134 | 1053.1 | 2056.3 | 51.2 | 1.9 |
| D527E, D544N, T770G, M784I | 136 | 1064.7 | 2100.3 | 50.7 | 1.9 |
| D527E, E557R, T770G, M784I | 138 | 1061.0 | 2068.1 | 51.3 | 1.9 |
| E557W, E757A, T770G | 140 | 1105.0 | 2156.9 | 51.2 | 1.9 |
| E557R, E757A, V771F | 142 | 1065.4 | 2153.7 | 49.5 | 1.9 |
| E757A, T770G | 144 | 1032.3 | 2079.9 | 49.6 | 1.8 |
| Control: SEQ ID NO: 38 | 38 | 610.4 | 2277.2 | 26.8 | 1.0 |

FOIC: Fold improvement over control;
control is bold

Example 11: Combinatorial Library of the Catalytic and Reductase Domain of cyp153A(Q12W, R27L, K119R, S140N, S157R, V159M, S233L, A244R, G307A)-Red450RhF(A796V) Fusion Protein (SEQ ID:98)

Beneficial mutations identified in the combinatorial libraries of the catalytic and reductase domains (see Examples 8-10, supra) were the basis for a combination library to further improve the cyp153A(Q12W, R27L, K119R, S140N, S157R, V159M, S233L, A244R, G307A)-Red450RhF(A796V) fusion protein (SEQ ID NO: 98). The selection criteria was (1) an increased amount of ω-hydroxy fatty acids (ω-OH FFA titer); and/or (2) increased conversion of fatty acids to ω-hydroxy fatty acids.

The combination library was constructed in pEP.333 plasmid, a derivative of pEP302 (see example 7), harboring the cyp153A(Q12W, R27L, K119R, S140N, S157R, V159M, S233L, A244R, G307A)-Red450RhF(A796V) fusion protein (SEQ ID NO: 98) and transformed into stNH1525. Standard techniques known to those of skill in the art were used to prepare combination libraries. The library was screened using one of the standard protocols described above.

The improved variants are shown in Table 15. Some mutations in the template of SEQ ID NO: 98 were reverted back to wild type as shown by Table 15. For example, in the forth mutant shown in Table 15 the S233L and A244R mutation is no longer present in the variant of SEQ ID NO: 152 while new mutations V141T and A231Y were added.

TABLE 15

Improved variants from a combinatorial library of the catalytic and reductase domain of the cyp153A(Q12W, R27L, K119R, S140N, S157R, V159M, S233L, A244R, G307A)-Red450RhF(A796V) fusion protein (SEQ ID NO: 98)

| P450 mutations | RhF domain mutations | SEQ ID NO: | ω-OH FFA | FAS | % ω-OH FFA | FOIC |
|---|---|---|---|---|---|---|
| V141T, A231Y, N407G | | 146 | 1406.6 | 3101.0 | 45.4 | 1.5 |
| V141T, A231Y, L233S, R254G | | 148 | 1200.9 | 2858.6 | 42.0 | 1.4 |
| A231Y, N407G, V451M | E757A, T770G, M784I | 150 | 855.2 | 2048.1 | 41.8 | 1.4 |
| V141T, A231Y, L233S, R244A | | 152 | 1189.8 | 2912.9 | 40.8 | 1.4 |
| V141T, A231Y, R244A, V451M | E557W, E749L, T770G | 154 | 1142.5 | 2773.8 | 41.2 | 1.4 |
| L27R, Q28M, N61L, V141T, P149G, A231Y | | 156 | 1207.5 | 2983.3 | 40.5 | 1.3 |
| V141T, R157S, A231Y, L233S, R244A | E757A, M784I | 158 | 1250.2 | 3075.4 | 40.7 | 1.3 |
| A231Y, N407G | E591Q, R643H, E757A, M784I | 160 | 1101.6 | 2730.0 | 40.4 | 1.3 |
| Q28M, N61L, N140S, V141T, A231Y, L233S, E271D | | 162 | 1168.9 | 2984.3 | 39.2 | 1.3 |
| A231Y, L233S, R254G | E557W | 164 | 1101.4 | 2869.8 | 38.4 | 1.3 |
| Control: SEQ ID NO: 98 | | 98 | 882.4 | 2940.5 | 30.0 | 1.0 |

FOIC: Fold improvement over control; control is bold

Example 12: Combinatorial Library of the Catalytic Domain of cyp153A(Q12W, R27L, K119R, S140N, S157R, V159M, S233L, A244R, G307A)-Red450RhF(A796V) Fusion Protein (SEQ ID: 98)

Beneficial mutations identified in the combinatorial library of the catalytic domain (see Example 8, supra) were the basis for a combination library to further improve the cyp153A (Q12W, R27L, K119R, S140N, S157R, V159M, S233L, A244R, G307A)-Red450RhF(A796V) fusion protein of SEQ ID NO: 98. The selection criteria was (1) an increased amount of ω-hydroxy fatty acids (ω-OH FFA titer); and/or (2) increased conversion of fatty acids to ω-hydroxy fatty acids.

The combination library was constructed in pEP.334 plasmid, a lower-copy number derivative of pEP.333 plasmid (see example 11), harboring the cyp153A(Q12W, R27L, K119R, S140N, S157R, V159M, S233L, A244R, G307A)-Red450RhF(A796V) fusion protein (SEQ ID NO: 98) at higher expression level and a second operon with a variant of thioesterase fatA3 and beta-ketoacyl-ACP synthase fabB. pEP344 was transformed into strain AA.233, which is a derivative of strain stNH1525 (see example 7) with a variant of a regulatory protein, fadR, constitutively expressed. Standard techniques known to those of skill in the art were used to prepare combination libraries. The library was screened using one of the standard protocols described above. The improved variants are shown in Table 16. Some mutations in the template of SEQ ID NO: 98 were reverted back too wild type as shown by Table 16. For example, in the first mutant shown in Table 16 the S140N mutation is no longer present in the variant of SEQ ID NO: 166 while new mutations Q28M, V141T and A231Y were added.

TABLE 16

Improved protein variants from a combinatorial library of the catalytic domain of the cyp153A(Q12W, R27L, K119R, S140N, S157R, V159M, S233L, A244R, G307A)-Red450RhF(A796V) fusion protein (SEQ ID NO: 98)

| P450 mutation | AA SEQ ID | ω-OH FFA | FAS | % ω-OH FFA | FOIC |
|---|---|---|---|---|---|
| Q12W, R27L, Q28M, K119R, V141T, S157R, V159M, A231Y, S233L, A244R, G307A, A796V | 166 | 2542.0 | 3727.3 | 68 | 1.2 |
| Q12W, Q28M, K119R, S140N, S157R, V159M, S233L, A244R, R254G, G307A, N407G, A796V | 168 | 2272.3 | 3491.8 | 65 | 1.1 |
| Q12W, R27L, F111A, K119R, V141T, S157R, V159M, A231Y, S233L, A244R, R254G, G307A, A796V | 170 | 2228.0 | 3610.5 | 62 | 1.1 |
| Q12W, Q28M, K119R, S140N, P149G, S157R, V159M, A231Y, S233L, G307A, N407G, A796V | 172 | 2385.5 | 3680.9 | 65 | 1.1 |
| Q12W, R27L, Q28M, K119R, S140N, S157R, V159M, S233L, A244R, G307A, N407G, A796V | 174 | 2384.4 | 3628.9 | 66 | 1.1 |
| D10Y, I11L, Q12W, Q28M, K119R, V141T, V159M, A231Y, S233L, A244R, G307A, N407G, A796V | 176 | 3317.0 | 5004.6 | 66.3 | 1.1 |
| I11L, Q12W, R27L, Q28M, K119R, V141T, S157R, V159M, A197T, A231Y, S233L, A244R, G307A, N407G, P477G, A796V | 178 | 3160.4 | 4755.7 | 66.5 | 1.2 |
| I11L, Q12w, Q28M, K119R, V141T, S157R, V159M, A197T, A231Y, S233L, A244R, G307A, N407G, A796V | 180 | 3148.0 | 4838.3 | 65.1 | 1.1 |
| I11L, Q12W, R27L, Q28M, K119R, V141T, P149G, S157R, V159M, A231Y, S233L, G307A, N407G, A796V | 182 | 3061.6 | 4489.7 | 68.2 | 1.2 |
| D10Y, I11L, Q12W, R27L, Q28M, K119R, V141T, S157R, V159M, A231Y, S233L, A244R, G307A, A796V | | 3029.3 | 4376.7 | 69.2 | 1.2 |
| Control: SEQ ID NO: 98 | 98 | 2068.9 | 3586.1 | 58 | 1.0 |

FOIC: Fold improvement over control;
control is bold

As is apparent to one with skill in the art, various modifications and variations of the above aspects and embodiments can be made without departing from the spirit and scope of this disclosure. Such modifications and variations are within the scope of this disclosure.

SEQUENCE LISTING (184 sequences)

SEQ ID NO: 1 - DNA, 1413 bp, Marinobacter aquaeolei
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcggcggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagttaa

SEQ ID NO: 2 - protein, 470 aa, Marinobacter aquaeolei
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVGGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNS

SEQ ID NO: 3 - DNA, 1413 bp, Marinobacter aquaeolei
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagttaa

SEQ ID NO: 4 - protein, 470 aa, Marinobacter aquaeolei
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNS

SEQ ID NO: 5 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 6 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 7 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagctgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 8 - protein, 799 aa, Artificial Sequence
  source: /note="Description of Artificial Sequence: Synthetic polypeptide"
MPTLPRTFDDIQSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 9 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtgggacgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 10 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWDAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 11 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgatcgaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 12 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSIEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 13 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgcaggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 14 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSQEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 15 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgggggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 16 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSGEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 17 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgatggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 18 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSMEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 19 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgctggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 20 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSLEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 21 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgacggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 22 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSTEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 23 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcaaacaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 24 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSNTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 25 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggccgggatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 26 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGRDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 27 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcggcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 28 - protein, 799 aa, Artificial Sequence; identical to SEQ ID NO: 6
  source: /note="Description of Artificial Sequence: Synthetic polypeptide"

SEQ ID NO: 29 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatgggcgtcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 30 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGRHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 31 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgatcgaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtacagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 32 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSIEMFIAMDPPKHDVQRSSVQGVVAPKNLKEMEGLIRSRTGDVLDSLPTDKPFNWVPAVSKELTGRMLATLLDFPYEERHKLVEWSDRMAGTASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 33 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagctgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtgggacgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgatggaaatgttcatagcgatggatccgccgaaacacgatgtgcagcgcagctcggtgcagggagtagtggcaccgaaaaacctgaaggagatggaggggctgatccgatcaaacaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcgcggatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 34 - protein, 799 aa, Artificial Sequence
  source: /note="Description of Artificial Sequence: Synthetic polypeptide"
MPTLPRTFDDIQSRLINATSRVVPMQLQIQGLKFLMSAKRKTFGPRRPMPEFVETPIPDVNTLALEDIDVSNPFLYRQGQWDAYFKRLRDEAPVHYQKNSPFGPFWSVTRFEDILFVDKSHDLFSAEPQIILGDPPEGLSMEMFIAMDPPKHDVQRSSVQGVVAPKNLKEMEGLIRSNTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGADTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 35 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcggcgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggcgctgcgcctctaa

SEQ ID NO: 36 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAAGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLALRL

SEQ ID NO: 37 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 38 - protein, 799 aa, Artificial Sequence [sequence omitted]

SEQ ID NO: 39 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaagtcctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcggacggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 40 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKVLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPADGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 41 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgatcgaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtacagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 42 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSIEMFIAMDPPKHDVQRSSVQGVVAPKNLKEMEGLIRSRTGDVLDSLPTDKPFNWVPAVSKELTGRMLATLLDFPYEERHKLVEWSDRMAGTASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 43 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagctgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtgggacgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgatggaaatgttcatagcgatggatccgccgaaacacgatgtgcagcgcagctcggtgcagggagtagtggcaccgaaaaacctgaaggagatggaggggctgatccgatcaaacaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcgcggatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 44 - protein, 799 aa, Artificial Sequence
  source: /note="Description of Artificial Sequence: Synthetic polypeptide"
MPTLPRTFDDIQSRLINATSRVVPMQLQIQGLKFLMSAKRKTFGPRRPMPEFVETPIPDVNTLALEDIDVSNPFLYRQGQWDAYFKRLRDEAPVHYQKNSPFGPFWSVTRFEDILFVDKSHDLFSAEPQIILGDPPEGLSMEMFIAMDPPKHDVQRSSVQGVVAPKNLKEMEGLIRSNTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGADTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 45 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgacggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtacagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 46 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSTEMFIAMDPPKHDVQRSSVQGVVAPKNLKEMEGLIRSRTGDVLDSLPTDKPFNWVPAVSKELTGRMLATLLDFPYEERHKLVEWSDRMAGTASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 47 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcgaactgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 48 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSNCEEGLCGSCEVAVLDGEVDHRDTVLTKAERAANRQMMTCCSRACGDRLVLRL

SEQ ID NO: 49 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 50 - protein, 799 aa, Artificial Sequence
  source: /note="Description of Artificial Sequence: Synthetic polypeptide"
MPTLPRTFDDIWSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 51 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattcgatagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 52 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFDREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 53 - DNA, 2400 bp, Artificial Sequence
  source: /note="Description of Artificial Sequence: Synthetic polynucleotide"
atgccaacactgcccagaacatttgacgacattcagtccttcctgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 54 - protein, 799 aa, Artificial Sequence
  source: /note="Description of Artificial Sequence: Synthetic polypeptide"
MPTLPRTFDDIQSFLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 55 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttttgacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 56 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVLTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 57 - DNA, 2400 bp, Artificial Sequence; identical to SEQ ID NO: 37
  source: /note="Description of Artificial Sequence: Synthetic polynucleotide"

SEQ ID NO: 58 - protein, 799 aa, Artificial Sequence [sequence omitted]

SEQ ID NO: 59 - DNA, 2400 bp, Artificial Sequence
  source: /note="Description of Artificial Sequence: Synthetic polynucleotide"
atgccaacactgcccagaacatttgacgacattcagaagcgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 60 - protein, 799 aa, Artificial Sequence
  source: /note="Description of Artificial Sequence: Synthetic polypeptide"
MPTLPRTFDDIQKRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 61 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccttcctgactaaggccgagcgcgccgcgaatcgtcagatgatgacttgctgcagtcgtgcatgcggtgatcgtctggtcctgcgcctctaa

SEQ ID NO: 62 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTFLTKAERAANRQMMTCCSRACGDRLVLRL

SEQ ID NO: 63 - DNA, 2400 bp, Artificial Sequence
  source: /note="Description of Artificial Sequence: Synthetic polynucleotide"
atgccaacactgcccagaacatttgacgacattacgtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 64 - protein, 799 aa, Artificial Sequence
  source: /note="Description of Artificial Sequence: Synthetic polypeptide"
MPTLPRTFDDITSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 65 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 66 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 67 - DNA, 2400 bp, Artificial Sequence
  source: /note="Description of Artificial Sequence: Synthetic polynucleotide"
atgccaacactgcccagaacatttgactacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 68 - protein, 799 aa, Artificial Sequence
  source: /note="Description of Artificial Sequence: Synthetic polypeptide"
MPTLPRTFDYIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 69 - DNA, 2400 bp, Artificial Sequence
  source: /note="Description of Artificial Sequence: Synthetic polynucleotide"
atgccaacactgcccagaacatttgacgacattaggtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 70 - protein, 799 aa, Artificial Sequence
  source: /note="Description of Artificial Sequence: Synthetic polypeptide"
MPTLPRTFDDIRSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 71 - DNA, 2400 bp, Artificial Sequence
  source: /note="Description of Artificial Sequence: Synthetic polynucleotide"
atgccaacactgcccagaacatttgacgacttgcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 72 - protein, 799 aa, Artificial Sequence
  source: /note="Description of Artificial Sequence: Synthetic polypeptide"
MPTLPRTFDDLQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 73 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggacgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 74 - protein, 799 aa, Artificial Sequence
  source: /note="Description of Artificial Sequence: Synthetic polypeptide"
MPTLPRTFDDIQSRLINATSRVVPMQRTIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 75 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 76 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGYASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 77 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtccgctcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 78 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVRSDCEEGLCGSCEVAVLDGEVDHRDTVLTKAERAANRQMMTCCSRACGDRLVLRL

SEQ ID NO: 79 - DNA, 2400 bp, Artificial Sequence; identical to SEQ ID NO: 37
  source: /note="Description of Artificial Sequence: Synthetic polynucleotide"

SEQ ID NO: 80 - protein, 799 aa, Artificial Sequence [sequence omitted]

SEQ ID NO: 81 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgatggtgttctgactaaggccgagcgcgccgcgaatcgtcagatgatgacttgctgcagtcgtgcatgcggtgatcgtctggtcctgcgcctctaa

SEQ ID NO: 82 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDGVLTKAERAANRQMMTCCSRACGDRLVLRL

SEQ ID NO: 83 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggcaggggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 84 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGRGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 85 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatcacttgctgcagtcgtgcatgcggtgatcgtctggtcctgcgcctctaa

SEQ ID NO: 86 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMITCCSRACGDRLVLRL

SEQ ID NO: 87 - DNA, 2400 bp, Artificial Sequence
  source: /note="Description of Artificial Sequence: Synthetic polynucleotide"
atgccaacactgcccagaacatttaaggacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 88 - protein, 799 aa, Artificial Sequence
  source: /note="Description of Artificial Sequence: Synthetic polypeptide"
MPTLPRTFKDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 89 - DNA, 2400 bp, Artificial Sequence; identical to SEQ ID NO: 37
  source: /note="Description of Artificial Sequence: Synthetic polynucleotide"

SEQ ID NO: 90 - protein, 799 aa, Artificial Sequence [sequence omitted]

SEQ ID NO: 91 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcattggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 92 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAALATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 93 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 94 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCAVAVLDGEVDHRDTVLTKAERAANRQMMTCCSRACGDRLVLRL

SEQ ID NO: 95 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtggggccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 96 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSGAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 97 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacgtggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 98 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNVEMFIAMDPPKHDVQRRSMQGVVAPKNLKEMEGLIRSRTGDVLDSLPTDKPFNWVPAVSKELTGRMLATLLDFPYEERHKLVEWSDRMAGAALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 99 - DNA, 2400 bp, Artificial Sequence
  source: /note="Description of Artificial Sequence: Synthetic polynucleotide"
atgccaacactgcccagaacatttgacgacattaggtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttttgacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgtagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggctctgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggcaggggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccggtggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 100 - protein, 799 aa, Artificial Sequence
  source: /note="Description of Artificial Sequence: Synthetic polypeptide"
MPTLPRTFDDIRSRLINATSRVVPMQRMIQGLKFLMSAKRKTFGPRRPMPEFVETPIPDVLTLALEDIDVSNPFLYRQGQWRAYFKRLRDEAPVHYQKNSPFGPFWSVTRFEDILFVDRSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGVASATGGEFADENAMFDDAADMARSFSRLWRDKEARRAAGEEPGFDLISLLQSNKETKDLINRPMEFIGNLTLLIVAGSDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGRGVHRCMGNRLAELQLRILWEEILKRFDNIEVVEEPERVQSNFVRGYSRLMVKLTPNSVLHRHQPVTGGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 101 - DNA, 2400 bp, Artificial Sequence
  source: /note="Description of Artificial Sequence: Synthetic polynucleotide"
atgccaacactgcccagaacatttgacgacattaggtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgtagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccggtggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 102 - protein, 799 aa, Artificial Sequence
  source: /note="Description of Artificial Sequence: Synthetic polypeptide"
MPTLPRTFDDIRSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGVASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTGGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 103 - DNA, 2400 bp, Artificial Sequence
  source: /note="Description of Artificial Sequence: Synthetic polynucleotide"
atgccaacactgcccagaacatttgacgacattacgtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccagcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcgacggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttgggcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 104 - protein, 799 aa, Artificial Sequence
  source: /note="Description of Artificial Sequence: Synthetic polypeptide"
MPTLPRTFDDITSRLINATSRVVPMQRMIQGLKFLMSAKRKTFGPRRPMPEFVETPIPDVNTLALEDIDVSNPFLYQQGQWRAYFKRLRDEAPVHYQKNSPFGPFWSVTRFEDILFVDRSHDLFSAEPQIILGDPPEGLSTEMFIAMDPPKHDVQRSSVQGVVAPKNLKEMEGLIRSRTGDVLDSLPTDKPFNWVPAVSKELTGRMLATLLDFPYEERHKLVEWSDRMAGWASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 105 - DNA, 2400 bp, Artificial Sequence
  source: /note="Description of Artificial Sequence: Synthetic polynucleotide"
atgccaacactgcccagaacatttgacgacattaggtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttttgacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgacggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 106 - protein, 799 aa, Artificial Sequence
  source: /note="Description of Artificial Sequence: Synthetic polypeptide"
MPTLPRTFDDIRSRLINATSRVVPMQRMIQGLKFLMSAKRKTFGPRRPMPEFVETPIPDVLTLALEDIDVSNPFLYRQGQWRAYFKRLRDEAPVHYQKNSPFGPFWSVTRFEDILFVDKSHDLFSAEPQIILGDPPEGLSTEMFIAMDPPKHDVQRSSVQGVVAPKNLKEMEGLIRSRTGDVLDSLPTDKPFNWVPAVSKELTGRMLATLLDFPYEERHKLVEWSDRMAGYASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 107 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 108 - protein, 799 aa, Artificial Sequence
  source: /note="Description of Artificial Sequence: Synthetic polypeptide"
MPTLPRTFDDIWSRLINATSRVVPMQRMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGYASATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 109 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggacgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccggtggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 110 - protein, 799 aa, Artificial Sequence
  source: /note="Description of Artificial Sequence: Synthetic polypeptide"
MPTLPRTFDDIWSRLINATSRVVPMQRTIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTGGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 111 - DNA, 2400 bp, Artificial Sequence
  source: /note="Description of Artificial Sequence: Synthetic polynucleotide"
atgccaacactgcccagaacatttgacgacattaggtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcgacggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggcaggggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcattgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 112 - protein, 799 aa, Artificial Sequence
  source: /note="Description of Artificial Sequence: Synthetic polypeptide"
MPTLPRTFDDIRSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSTEMFIAMDPPKHDVQRSSVQGVVAPKNLKEMEGLIRSRTGDVLDSLPTDKPFNWVPAVSKELTGRMLATLLDFPYEERHKLVEWSDRMAGYASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGRGVHRCMGNRLAELQLRILWEEILKRFDNIEVVEEPERVQSNFVRGYSRLMVKLTPNSVLHRHQPVTIIEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 113 - DNA, 2400 bp, Artificial Sequence
  source: /note="Description of Artificial Sequence: Synthetic polynucleotide"
atgccaacactgcccagaacatttgacgacattacgtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcgggcggaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgtagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 114 - protein, 799 aa, Artificial Sequence
  source: /note="Description of Artificial Sequence: Synthetic polypeptide"
MPTLPRTFDDITSRLINATSRVVPMQRMIQGLKFLMSAKRKTFGPRRPMPEFVETPIPDVNTLALEDIDVSNPFLYRQGQWRAYFKRLRDEAPVHYQKNSPFGPFWSVTRAEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGVASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 115 - DNA, 2400 bp, Artificial Sequence
  source: /note="Description of Artificial Sequence: Synthetic polynucleotide"
atgccaacactgcccagaacatttgacgacattacgtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttttgacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgaacgtggaaatgttcatagcgatggataggccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 116 - protein, 799 aa, Artificial Sequence
  source: /note="Description of Artificial Sequence: Synthetic polypeptide"
MPTLPRTFDDITSRLINATSRVVPMQRMIQGLKFLMSAKRKTFGPRRPMPEFVETPIPDVLTLALEDIDVSNPFLYRQGQWRAYFKRLRDEAPVHYQKNSPFGPFWSVTRFEDILFVDKSHDLFSAEPQIILGDPPEGLNVEMFIAMDRPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 117 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggacgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccagcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcggtggaaatgttcatagcgatggatccgccgaaacacgatgtgcagcgcagctcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatgccatgtttgacgacgcggcagacatggccgggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccggtggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 118 - protein, 799 aa, Artificial Sequence
  source: /note="Description of Artificial Sequence: Synthetic polypeptide"
MPTLPRTFDDIWSRLINATSRVVPMQRTIQGLKFLMSAKRKTFGPRRPMPEFVETPIPDVNTLALEDIDVSNPFLYQQGQWRAYFKRLRDEAPVHYQKNSPFGPFWSVTRFEDILFVDRSHDLFSAEPQIILGDPPEGLSVEMFIAMDPPKHDVQRSSMQGVVAPKNLKEMEGLIRSRTGDVLDSLPTDKPFNWVPAVSKELTGRMLATLLDFPYEERHKLVEWSDRMAGYASATGGEFADENAMFDDAADMAGSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTGGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 119 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggacgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggccgggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggctctgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcggatgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 120 - protein, 799 aa, Artificial Sequence
  source: /note="Description of Artificial Sequence: Synthetic polypeptide"
MPTLPRTFDDIWSRLINATSRVVPMQRTIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMAGSFSRLWRDKEARRAAGEEPGFDLISLLQSNKETKDLINRPMEFIGNLTLLIVAGSDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERMQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 121 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggacgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggccgggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggctctgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccggtggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 122 - protein, 799 aa, Artificial Sequence
  source: /note="Description of Artificial Sequence: Synthetic polypeptide"
MPTLPRTFDDIWSRLINATSRVVPMQRTIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMAGSFSRLWRDKEARRAAGEEPGFDLISLLQSNKETKDLINRPMEFIGNLTLLIVAGSDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTGGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 123 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggacgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggctctgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcggatgcagtccaacttcgtgcggggctattccaggttgatggtcaaactgacaccgaacagtgtactccatcgtcatcaacctgtcaccggtggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 124 - protein, 799 aa, Artificial Sequence
  source: /note="Description of Artificial Sequence: Synthetic polypeptide"
MPTLPRTFDDIWSRLINATSRVVPMQRTIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGSDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERMQSNFVRGYSRLMVKLTPNSVLHRHQPVTGGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 125 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgagctggatctgggtgctctgagccgtcagtattcgctctgcggcgctccgaacgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgtgggactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgataccttcctgactaaggccgagcgcgccgcgaatcgtcagatgatcacttgctgcagtcgtgcatgcggtgatcgtctggtcctgcgcctctaa

SEQ ID NO: 126 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIELDLGALSRQYSLCGAPNAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELWDSGLTVRVEPTQTVLDALRANNIDVPSDCEEGLCGSCAVAVLDGEVDHRDTFLTKAERAANRQMITCCSRACGDRLVLRL

SEQ ID NO: 127 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgagctggatctgggtgctctgagccgtcagtattcgctctgcggcgctccgaacgctccgtcgtacgaaatcgccgtgcacttagatccgcggagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 128 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIELDLGALSRQYSLCGAPNAPSYEIAVHLDPRSRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 129 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgatggtgttctgactaaggccgagcgcgccgcgaatcgtcagatgatcacttgctgcagtcgtgcatgcggtgatcgtctggtcctgcgcctctaa

SEQ ID NO: 130 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDGVLTKAERAANRQMITCCSRACGDRLVLRL

SEQ ID NO: 131 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgagctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcgcagcattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacttgtctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgtgggactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgataccttcctgactaaggccgagcgcgccgcgaatcgtcagatgatcacttgctgcagtcgtgcatgcggtgatcgtctggtcctgcgcctctaa

SEQ ID NO: 132 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIELDLGALSRQYSLCGAPDAPSYEIAVHLDPESRGGSRYIHEQLEVGSPLRMRGPRNHFALDPGAQHYVFVAGGIGITPVLAMADHARARGWSYELHYCGRNRSGMAYLERVAGHGDRAALHLSEEGTRIDLAALLAEPAPGVQIYACGPGRLLAGLEDASRNWPDGALHVEHFTSSLAALDPDVEHAFDLELWDSGLTVRVEPTQTVLDALRANNIDVPSDCEEGLCGSCAVAVLDGEVDHRDTFLTKAERAANRQMITCCSRACGDRLVLRL

SEQ ID NO: 133 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgagctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcgcagcattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacttgtctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgataccttcctgactaaggccgagcgcgccgcgaatcgtcagatgatgacttgctgcagtcgtgcatgcggtgatcgtctggtcctgcgcctctaa

SEQ ID NO: 134 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIELDLGALSRQYSLCGAPDAPSYEIAVHLDPESRGGSRYIHEQLEVGSPLRMRGPRNHFALDPGAQHYVFVAGGIGITPVLAMADHARARGWSYELHYCGRNRSGMAYLERVAGHGDRAALHLSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCAVAVLDGEVDHRDTFLTKAERAANRQMMTCCSRACGDRLVLRL

SEQ ID NO: 135 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgagctggatctgggtgctctgagccgtcagtattcgctctgcggcgctccgaacgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgatggtgttctgactaaggccgagcgcgccgcgaatcgtcagatgatcacttgctgcagtcgtgcatgcggtgatcgtctggtcctgcgcctctaa

SEQ ID NO: 136 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIELDLGALSRQYSLCGAPNAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDGVLTKAERAANRQMITCCSRACGDRLVLRL

SEQ ID NO: 137 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgagctggatctgggtgctctgagccgtcagtattcgctctgcggcgctccggatgctccgtcgtacgaaatcgccgtgcacttagatccgcggagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgatggtgttctgactaaggccgagcgcgccgcgaatcgtcagatgatcacttgctgcagtcgtgcatgcggtgatcgtctggtcctgcgcctctaa

SEQ ID NO: 138 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIELDLGALSRQYSLCGAPDAPSYEIAVHLDPRSRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDGVLTKAERAANRQMITCCSRACGDRLVLRL

SEQ ID NO: 139 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccgtggagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgatggtgttctgactaaggccgagcgcgccgcgaatcgtcagatgatgacttgctgcagtcgtgcatgcggtgatcgtctggtcctgcgcctctaa

SEQ ID NO: 140 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPWSRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCAVAVLDGEVDHRDGVLTKAERAANRQMMTCCSRACGDRLVLRL

SEQ ID NO: 141 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccgcggagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgataccttcctgactaaggccgagcgcgccgcgaatcgtcagatgatgacttgctgcagtcgtgcatgcggtgatcgtctggtcctgcgcctctaa

SEQ ID NO: 142 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPRSRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCAVAVLDGEVDHRDTFLTKAERAANRQMMTCCSRACGDRLVLRL

SEQ ID NO: 143 - DNA, 2400 bp, Artificial Sequence
  source: /note="Description of Artificial Sequence: Synthetic polynucleotide"
atgccaacactgcccagaacatttgacgacattcagtcccgactgattaacgccacctccagggtggtgccgatgcagaggcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggataagagtcacgacctgttttccgccgagccgcaaatcattctcggtgaccctccggaggggctgtcggtggaaatgttcatagcgatggatccgccgaaacacgatgtgcagcgcagctcggtgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgatggtgttctgactaaggccgagcgcgccgcgaatcgtcagatgatgacttgctgcagtcgtgcatgcggtgatcgtctggtcctgcgcctctaa

SEQ ID NO: 144 - protein, 799 aa, Artificial Sequence
  source: /note="Description of Artificial Sequence: Synthetic polypeptide"
MPTLPRTFDDIQSRLINATSRVVPMQRQIQGLKFLMSAKRKTFGPRRPMPEFVETPIPDVNTLALEDIDVSNPFLYRQGQWRAYFKRLRDEAPVHYQKNSPFGPFWSVTRFEDILFVDKSHDLFSAEPQIILGDPPEGLSVEMFIAMDPPKHDVQRSSVQGVVAPKNLKEMEGLIRSRTGDVLDSLPTDKPFNWVPAVSKELTGRMLATLLDFPYEERHKLVEWSDRMAGAASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCAVAVLDGEVDHRDGVLTKAERAANRQMMTCCSRACGDRLVLRL

SEQ ID NO: 145 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 146 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNTEMFIAMDPPKHDVQRRSMQGVVAPKNLKEMEGLIRSRTGDVLDSLPTDKPFNWVPAVSKELTGRMLATLLDFPYEERHKLVEWSDRMAGYALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 147 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatcggatgtttgacgacgcggcagacatggccgggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 148 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNTEMFIAMDPPKHDVQRRSMQGVVAPKNLKEMEGLIRSRTGDVLDSLPTDKPFNWVPAVSKELTGRMLATLLDFPYEERHKLVEWSDRMAGYASATGGEFADENRMFDDAADMAGSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 149 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacgtggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcggatgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgatggtgttctgactaaggccgagcgcgccgcgaatcgtcagatgatcacttgctgcagtcgtgcatgcggtgatcgtctggtcctgcgcctctaa

SEQ ID NO: 150 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNVEMFIAMDPPKHDVQRRSMQGVVAPKNLKEMEGLIRSRTGDVLDSLPTDKPFNWVPAVSKELTGRMLATLLDFPYEERHKLVEWSDRMAGYALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERMQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCAVAVLDGEVDHRDGVLTKAERAANRQMITCCSRACGDRLVLRL

SEQ ID NO: 151 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 152 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNTEMFIAMDPPKHDVQRRSMQGVVAPKNLKEMEGLIRSRTGDVLDSLPTDKPFNWVPAVSKELTGRMLATLLDFPYEERHKLVEWSDRMAGYASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 153 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcggatgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccgtggagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcttggaggggctgtgtggttcttgcgaagtagccgttctggatggcgaggttgatcaccgtgatggtgttctgactaaggccgagcgcgccgcgaatcgtcagatgatgacttgctgcagtcgtgcatgcggtgatcgtctggtcctgcgcctctaa

SEQ ID NO: 154 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNTEMFIAMDPPKHDVQRRSMQGVVAPKNLKEMEGLIRSRTGDVLDSLPTDKPFNWVPAVSKELTGRMLATLLDFPYEERHKLVEWSDRMAGYALATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERMQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPWSRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCLEGLCGSCEVAVLDGEVDHRDGVLTKAERAANRQMMTCCSRACGDRLVLRL

SEQ ID NO: 155 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttttgacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacacggaaatgttcatagcgatggatgggccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 156 - protein, 799 aa, Artificial Sequence
  source: /note="Description of Artificial Sequence: Synthetic polypeptide"
MPTLPRTFDDIWSRLINATSRVVPMQRMIQGLKFLMSAKRKTFGPRRPMPEFVETPIPDVLTLALEDIDVSNPFLYRQGQWRAYFKRLRDEAPVHYQKNSPFGPFWSVTRFEDILFVDRSHDLFSAEPQIILGDPPEGLNTEMFIAMDGPKHDVQRRSMQGVVAPKNLKEMEGLIRSRTGDVLDSLPTDKPFNWVPAVSKELTGRMLATLLDFPYEERHKLVEWSDRMAGYALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 157 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacacggaaatgttcatagcgatggatccgccgaaacacgatgtgcagcgcagctcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgataccgttctgactaaggccgagcgcgccgcgaatcgtcagatgatcacttgctgcagtcgtgcatgcggtgatcgtctggtcctgcgcctctaa

SEQ ID NO: 158 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNTEMFIAMDPPKHDVQRSSMQGVVAPKNLKEMEGLIRSRTGDVLDSLPTDKPFNWVPAVSKELTGRMLATLLDFPYEERHKLVEWSDRMAGYASATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCAVAVLDGEVDHRDTVLTKAERAANRQMITCCSRACGDRLVLRL

SEQ ID NO: 159 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacgtggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcgcagcattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccacgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgcggtagccgttctggatggcgaggttgatcaccgtgataccgttctgactaaggccgagcgcgccgcgaatcgtcagatgatcacttgctgcagtcgtgcatgcggtgatcgtctggtcctgcgcctctaa

SEQ ID NO: 160 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNVEMFIAMDPPKHDVQRRSMQGVVAPKNLKEMEGLIRSRTGDVLDSLPTDKPFNWVPAVSKELTGRMLATLLDFPYEERHKLVEWSDRMAGYALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAQHYVFVAGGIGITPVLAMADHARARGWSYELHYCGRNRSGMAYLERVAGHGDHAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCAVAVLDGEVDHRDTVLTKAERAANRQMITCCSRACGDRLVLRL

SEQ ID NO: 161 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgatgattcagggactgaaattcttaatgagcgccaagaggaagaccttcggcccacgccgaccgatgcccgaattcgttgaaacacccatcccggacgttttgacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcgacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatcggatgtttgacgacgcggcagacatggcccggtctttctccaggctttggcgggacaaggaggcgcgccgcgcagcaggcgacgagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 162 - protein, 799 aa, Artificial Sequence
  source: /note="Description of Artificial Sequence: Synthetic polypeptide"
MPTLPRTFDDIWSRLINATSRVVPMQLMIQGLKFLMSAKRKTFGPRRPMPEFVETPIPDVLTLALEDIDVSNPFLYRQGQWRAYFKRLRDEAPVHYQKNSPFGPFWSVTRFEDILFVDRSHDLFSAEPQIILGDPPEGLSTEMFIAMDPPKHDVQRRSMQGVVAPKNLKEMEGLIRSRTGDVLDSLPTDKPFNWVPAVSKELTGRMLATLLDFPYEERHKLVEWSDRMAGYASATGGEFADENRMFDDAADMARSFSRLWRDKEARRAAGDEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 163 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacgtggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcatcggccaccggcggggagtttgccgatgaaaatcggatgtttgacgacgcggcagacatggccgggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccgtggagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 164 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNVEMFIAMDPPKHDVQRRSMQGVVAPKNLKEMEGLIRSRTGDVLDSLPTDKPFNWVPAVSKELTGRMLATLLDFPYEERHKLVEWSDRMAGYASATGGEFADENRMFDDAADMAGSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPWSRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 165 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcgacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 166 - protein, 799 aa, Artificial Sequence
  source: /note="Description of Artificial Sequence: Synthetic polypeptide"
MPTLPRTFDDIWSRLINATSRVVPMQLMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLSTEMFIAMDPPKHDVQRRSMQGVVAPKNLKEMEGLIRSRTGDVLDSLPTDKPFNWVPAVSKELTGRMLATLLDFPYEERHKLVEWSDRMAGYALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 167 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacgtggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcattggccaccggcggggagtttgccgatgaaaatcggatgtttgacgacgcggcagacatggccgggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 168 - protein, 799 aa, Artificial Sequence
  source: /note="Description of Artificial Sequence: Synthetic polypeptide"
MPTLPRTFDDIWSRLINATSRVVPMQRMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNVEMFIAMDPPKHDVQRRSMQGVVAPKNLKEMEGLIRSRTGDVLDSLPTDKPFNWVPAVSKELTGRMLATLLDFPYEERHKLVEWSDRMAGAALATGGEFADENRMFDDAADMAGSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 169 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgcaaattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcgggcggaagacatcctgttcgtggatcggagtcacgacctgttttccgccgagccgcaaatcattctcggtgaccctccggaggggctgtcgacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggccgggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 170 - protein, 799 aa, Artificial Sequence
  source: /note="Description of Artificial Sequence: Synthetic polypeptide"
MPTLPRTFDDIWSRLINATSRVVPMQLQIQGLKFLMSAKRKTFGPRRPMPEFVETPIPDVNTLALEDIDVSNPFLYRQGQWRAYFKRLRDEAPVHYQKNSPFGPFWSVTRAEDILFVDRSHDLFSAEPQIILGDPPEGLSTEMFIAMDPPKHDVQRRSMQGVVAPKNLKEMEGLIRSRTGDVLDSLPTDKPFNWVPAVSKELTGRMLATLLDFPYEERHKLVEWSDRMAGYALATGGEFADENRMFDDAADMAGSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 171 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacgtggaaatgttcatagcgatggatgggccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 172 - protein, 799 aa, Artificial Sequence
  source: /note="Description of Artificial Sequence: Synthetic polypeptide"
MPTLPRTFDDIWSRLINATSRVVPMQRMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNVEMFIAMDGPKHDVQRRSMQGVVAPKNLKEMEGLIRSRTGDVLDSLPTDKPFNWVPAVSKELTGRMLATLLDFPYEERHKLVEWSDRMAGYALATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 173 - DNA, 2400 bp, Artificial Sequence
  source: /note="Description of Artificial Sequence: Synthetic polynucleotide"
atgccaacactgcccagaacatttgacgacatttggtcccgactgattaacgccacctccagggtggtgccgatgcagttgatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgaacgtggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggtgcagcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 174 - protein, 799 aa, Artificial Sequence
  source: /note="Description of Artificial Sequence: Synthetic polypeptide"
MPTLPRTFDDIWSRLINATSRVVPMQLMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLNVEMFIAMDPPKHDVQRRSMQGVVAPKNLKEMEGLIRSRTGDVLDSLPTDKPFNWVPAVSKELTGRMLATLLDFPYEERHKLVEWSDRMAGAALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 175 - DNA, 2400 bp, Artificial Sequence
  source: /note="Description of Artificial Sequence: Synthetic polynucleotide"
atgccaacactgcccagaacatttgactacttgtggtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcgacggaaatgttcatagcgatggatccgccgaaacacgatgtgcagcgcagctcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 176 - protein, 799 aa, Artificial Sequence
  source: /note="Description of Artificial Sequence: Synthetic polypeptide"
MPTLPRTFDYLWSRLINATSRVVPMQRMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLSTEMFIAMDPPKHDVQRSSMQGVVAPKNLKEMEGLIRSRTGDVLDSLPTDKPFNWVPAVSKELTGRMLATLLDFPYEERHKLVEWSDRMAGYALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 177 - DNA, 2400 bp, Artificial Sequence
  source: /note="Description of Artificial Sequence: Synthetic polynucleotide"
atgccaacactgcccagaacatttgacgacttgtggtcccgactgattaacgccacctccagggtggtgccgatgcagttgatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcgacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctactgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaaggggtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 178 - protein, 799 aa, Artificial Sequence
  source: /note="Description of Artificial Sequence: Synthetic polypeptide"
MPTLPRTFDDLWSRLINATSRVVPMQLMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLSTEMFIAMDPPKHDVQRRSMQGVVAPKNLKEMEGLIRSRTGDVLDSLPTDKPFNWVPTVSKELTGRMLATLLDFPYEERHKLVEWSDRMAGYALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQGVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 179 - DNA, 2400 bp, Artificial Sequence
  source: /note="Description of Artificial Sequence: Synthetic polynucleotide"
atgccaacactgcccagaacatttgacgacttgtggtcccgactgattaacgccacctccagggtggtgccgatgcagaggatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcgacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctactgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 180 - protein, 799 aa, Artificial Sequence
  source: /note="Description of Artificial Sequence: Synthetic polypeptide"
MPTLPRTFDDLWSRLINATSRVVPMQRMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLSTEMFIAMDPPKHDVQRRSMQGVVAPKNLKEMEGLIRSRTGDVLDSLPTDKPFNWVPTVSKELTGRMLATLLDFPYEERHKLVEWSDRMAGYALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 181 - DNA, 2400 bp, Artificial Sequence
  source: /note="Description of Artificial Sequence: Synthetic polynucleotide"
atgccaacactgcccagaacatttgacgacttgtggtcccgactgattaacgccacctccagggtggtgccgatgcagttgatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcgacggaaatgttcatagcgatggatgggccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatgccatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgagggcacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 182 - protein, 799 aa, Artificial Sequence
  source: /note="Description of Artificial Sequence: Synthetic polypeptide"
MPTLPRTFDDLWSRLINATSRVVPMQLMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLSTEMFIAMDGPKHDVQRRSMQGVVAPKNLKEMEGLIRSRTGDVLDSLPTDKPFNWVPAVSKELTGRMLATLLDFPYEERHKLVEWSDRMAGYALATGGEFADENAMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARGHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

SEQ ID NO: 183 - DNA, 2400 bp, Artificial Sequence
  source: /note="Description of Artificial Sequence: Synthetic polynucleotide"
atgccaacactgcccagaacatttgactacttgtggtcccgactgattaacgccacctccagggtggtgccgatgcagttgatgattcagggactgaaattcttaatgagcgccaagaggaagaccttcggcccacgccgaccgatgcccgaattcgttgaaacacccatcccggacgttaacacgctggcccttgaggacatcgatgtcagcaatccgtttttataccggcagggtcagtggcgcgcctatttcaaacggttgcgtgatgaggcgccggtccattaccagaagaacagccctttcggccccttctggtcggtaactcggtttgaagacatcctgttcgtggatcggagtcacgacctgttttccgccgagccgcaaatcattctcggtgaccctccggaggggctgtcgacggaaatgttcatagcgatggatccgccgaaacacgatgtgcagcgccggtcgatgcagggagtagtggcaccgaaaaacctgaaggagatggaggggctgatccgatcacgcaccggcgatgtgcttgacagcctgcctacagacaaaccctttaactgggtacctgctgtttccaaggaactcacaggccgcatgctggcgacgcttctggattttccttacgaggaacgccacaagctggttgagtggtcggacagaatggcaggttacgcattggccaccggcggggagtttgccgatgaaaatcggatgtttgacgacgcggcagacatggcccggtctttctccaggctttggcgggacaaggaggcgcgccgcgcagcaggcgaggagcccggtttcgatttgatcagcctgttgcagagcaacaaagaaacgaaagacctgatcaatcggccgatggagtttatcggtaatttgacgctgctcatagtcgccggcaacgatacgacgcgcaactcgatgagtggtggcctggtggccatgaacgaattccccagggaatttgaaaaattgaaggcaaaaccggagttgattccgaacatggtgtcggaaatcatccgctggcaaacgccgctggcctatatgcgccgaatcgccaagcaggatgtcgaactgggcggccagaccatcaagaagggtgatcgagttgtcatgtggtacgcgtcgggtaaccgggacgagcgcaaatttgacaaccccgatcagttcatcattgatcgcaaggacgcacgaaaccacatgtcgttcggctatggggttcaccgttgcatgggcaaccgtctggctgaactgcaactgcgcatcctctgggaagaaatactcaagcgttttgacaacatcgaagtcgtcgaagagcccgagcgggtgcagtccaacttcgtgcggggctattccaggttgatggtcaaactgacaccgaacagtgtactccatcgtcatcaacctgtcaccatcggcgagccggccgctcgtgctgtgagccgcacggtgaccgttgagcgtcttgatcgcattgccgacgatgtccttcgcctggtccttcgcgatgctggaggtaaaaccctcccgacgtggacgcctggcgctcacatcgacctggatctgggtgctctgagccgtcagtattcgctctgcggcgctccggatgctccgtcgtacgaaatcgccgtgcacttagatccggaaagccgtggtggaagccgctatattcatgaacagctggaagttggaagtccgctgcgtatgcgtggcccacgcaaccatttcgccctggatccgggtgcggaacattacgtgtttgttgccgggggtatcggcatcacgccggtgctggcaatggcggatcatgcccgtgcgcgtggttggtcgtacgaactgcattattgtggtcgtaatcgtagcggtatggcttacctggaacgcgtcgcgggacatggtgaccgcgctgccttgcacgtatctgaagaaggcacccgcattgatctggcggcattacttgctgaaccggcgccgggcgtgcaaatctacgcctgcggtccgggccgtttattagcgggtcttgaagacgcgtctcgtaattggccggatggcgcgcttcatgtggagcatttcacttcgagtttagccgctttggatccggatgtcgaacatgcctttgatttggagctgcgtgactctggccttaccgttcgcgtcgagccaactcagaccgttttagacgctttgcgtgcgaacaatatcgacgtcccgtcggattgcgaagaggggctgtgtggttcttgcgaagtagccgttctggatggcgaggttgatcaccgtgataccgttctgactaaggccgagcgcgccgcgaatcgtcagatgatgacttgctgcagtcgtgcatgcggtgatcgtctggtcctgcgcctctaa

SEQ ID NO: 184 - protein, 799 aa, Artificial Sequence
  source: /note="Description of Artificial Sequence: Synthetic polypeptide"
MPTLPRTFDYLWSRLINATSRVVPMQLMIQGLKFLMSAKRKTFGPRRPMPEFVETPIPDVNTLALEDIDVSNPFLYRQGQWRAYFKRLRDEAPVHYQKNSPFGPFWSVTRFEDILFVDRSHDLFSAEPQIILGDPPEGLSTEMFIAMDPPKHDVQRRSMQGVVAPKNLKEMEGLIRSRTGDVLDSLPTDKPFNWVPAVSKELTGRMLATLLDFPYEERHKLVEWSDRMAGYALATGGEFADENRMFDDAADMARSFSRLWRDKEARRAAGEEPGFDLISLLQSNKETKDLINRPMEFIGNLTLLIVAGNDTTRNSMSGGLVAMNEFPREFEKLKAKPELIPNMVSEIIRWQTPLAYMRRIAKQDVELGGQTIKKGDRVVMWYASGNRDERKFDNPDQFIIDRKDARNHMSFGYGVHRCMGNRLAELQLRILWEEILKRFDNIEVVEEPERVQSNFVRGYSRLMVKLTPNSVLHRHQPVTIGEPAARAVSRTVTVERLDRIADDVLRLVLRDAGGKTLPTWTPGAHIDLDLGALSRQYSLCGAPDAPSYEIAVHLDPESRGGSRYIHEQLEVGSPLRMRGPRNHFALDPGAEHYVFVAGGIGITPVLAMADHARARGWSYELHYCGRNRSGMAYLERVAGHGDRAALHVSEEGTRIDLAALLAEPAPGVQIYACGPGRLLAGLEDASRNWPDGALHVEHFTSSLAALDPDVEHAFDLELRDSGLTVRVEPTQTVLDALRANNIDVPSDCEEGLCGSCEVAVLDGEVDHRDTVLTKAERAANRQMMTCCSRACGDRLVLRL

What is claimed is:

1. A cytochrome P450 CYP153A reductase (CYP153A-reductase) hybrid fusion polypeptide variant having at least 90% sequence identity to the amino acid sequence of SEQ ID NO: 38 and having at least one mutation at an amino acid position corresponding to amino acid position: 9, 10, 11, 12, 13, 14, 28, 61, 77, 119, 159, 231, 233, 327, 413, 703, 745, 747, 749, 757, 770, 771 or 784, wherein the CYP153A-reductase hybrid fusion polypeptide variant has a mutation at each of amino acid positions:
(a) 12, 27, 28, 119, 141, 157, 159, 231, 233, and 244 of SEQ ID NO: 38;
(b) 12, 28, 119, 140, 157, 159, 233, 244, 254, and 407 of SEQ ID NO: 38;
(c) 12, 27, 111, 119, 141, 157, 159, 231, 233, 244, and 254 of SEQ ID NO: 38;
(d) 12, 28, 119, 140, 149, 157, 159, 231, 233, and 407 of SEQ ID NO: 38;
(e) 12, 27, 28, 119, 140, 157, 159, 233, 244, and 407 of SEQ ID NO: 38;
(f) 10, 11, 12, 28, 119, 141, 159, 231, 233, 244, and 407 of SEQ ID NO: 38;
(g) 11, 12, 27, 28, 119, 141, 157, 159, 197, 231, 233, 244, 407, and 477 of SE ID NO: 38;
(h) 11, 12, 28, 119, 141, 157, 159, 197, 231, 233, 244, and 407 of SEQ ID NO: 38; or
(i) 11, 12, 27, 28, 119, 141, 149, 157, 159, 231, 233, and 407 of SEQ ID NO: 38;
wherein the CYP153A-reductase hybrid fusion polypeptide variant catalyzes the conversion of a fatty acid to an omega-hydroxylated fatty acid.

2. The CYP153A-reductase hybrid fusion polypeptide variant of claim 1, wherein:
(a) the mutations at amino acid positions 12, 27, 28, 119, 141, 157, 159, 231, 233, and 244 of SEQ ID NO: 38 are Q12W, R27L, Q28M, K119R, V141T, S157R, V159M, A231Y, S233L, and A244R, respectively;
(b) the mutations at amino acid positions 12, 28, 119, 140, 157, 159, 233, 244, 254, and 407 of SEQ ID NO: 38 are Q12W, Q28M, K119R, S140N, S157R, V159M, S233L, A244R, R254G, and N407G, respectively;
(c) the mutations at amino acid positions 12, 27, 111, 119, 141, 157, 159, 231, 233, 244, and 254 of SEQ ID NO: 38 are Q12W, R27L, F111A, K119R, V141T, S157R, V159M, A231Y, S233L, A244R, and R254G, respectively;
(d) the mutations at amino acid positions 12, 28, 119, 140, 149, 157, 159, 231, 233, and 407 of SEQ ID NO: 38 are Q12W, Q28M, K119R, S140N, P149G, S157R, V159M, A231Y, S233L, and N407G, respectively;
(e) the mutations at amino acid positions 12, 27, 28, 119, 140, 157, 159, 233, 244, and 407 of SEQ ID NO: 38 are Q12W, R27L, Q28M, K119R, S140N, S157R, V159M, S233L, A244R, and N407G, respectively;
(f) the mutations at amino acid positions 10, 11, 12, 28, 119, 141, 159, 231, 233, 244, and 407 of SEQ ID NO: 38 are D10Y, I11L, Q12W, Q28M, K119R, V141T, V159M, A231Y, S233L, A244R, and N407G, respectively;
(g) the mutations at amino acid positions 11, 12, 27, 28, 119, 141, 157, 159, 197, 231, 233, 244, 407, and 477 of SEQ ID NO: 38 are I11L, Q12W, R27L, Q28M, K119R, V141T, S157R, V159M, A197T, A231Y, S233L, A244R, N407G, and P477G, respectively;
(h) the mutations at amino acid positions 11, 12, 28, 119, 141, 157, 159, 197, 231, 233, 244, and 407 of SEQ ID NO: 38 are I11L, Q12W, Q28M, K119R, V141T, S157R, V159M, A197T, A231Y, S233L, A244R, and N407G, respectively; and
(i) the mutations at amino acid positions 11, 12, 27, 28, 119, 141, 149, 157, 159, 231, 233, and 407 of SEQ ID NO: 38 are I11L, Q12W, R27L, Q28M, K119R, V141T, P149G, S157R, V159M, A231Y, S233L, and N407G, respectively.

3. The CYP153A-reductase hybrid fusion polypeptide variant of claim 1, wherein the CYP153A-reductase hybrid fusion polypeptide variant comprises a mutation at amino acid position 12 and at each of amino acid positions:
(a) 27, 119, 140, 157, 159, 233, and 244 of SEQ ID NO: 38;
(b) 28, 61, 119, 231, 309, 413, and 480 of SEQ ID NO: 38;
(c) 119, 231, and 480 of SEQ ID NO: 38;
(d) 28, 77, 119, 141, 231 and 407 of SEQ ID NO: 38;
(e) 28, 61, 141, 231, and 407 of SEQ ID NO: 38;
(f) 28, 119, 231, and 244 of SEQ ID NO: 38;
(g) 28, 407, and 480 of SEQ ID NO: 38;
(h) 141, 231, 413, and 481 of SEQ ID NO: 38;
(i) 28, 111, 231, and 407 of SEQ ID NO: 38;
(j) 28, 61, 140, and 149 of SEQ ID NO: 38;
(k) 28, 77, 119, 159, 231, 254, 407, and 480 of SEQ ID NO: 38;
(l) 28, 254, 309, 407, and 451 of SEQ ID NO: 38;
(m) 28, 254, 309, 407, and 480 of SEQ ID NO: 38; or
(n) 28, 309, 407, 451, and 480 of SEQ ID NO: 38;
wherein the CYP153A-reductase hybrid fusion polypeptide variant catalyzes the conversion of a fatty acid to an omega-hydroxylated fatty acid.

4. The CYP153A-reductase hybrid fusion polypeptide variant of claim 3, wherein:
(a) the mutations at amino acid positions 12, 27, 119, 140, 157, 159, 233, and 244 of SEQ ID NO: 38 are Q12W, R27L, K119R, S140N, S157R, V159M, S233L, and A244R, respectively;
(b) the mutations at amino acid positions 12, 28, 61, 119, 231, 309, 413, and 480 of SEQ ID NO: 38 are Q12R, Q28M, N61L, K119R, A231V, N309S, Y413R, and I480G, respectively;
(c) the mutations at amino acid positions 12, 119, 231, and 480 of SEQ ID NO: 38 are Q12R, K119R, A231V, and I480G, respectively;
(d) the mutations at amino acid positions 12, 28, 77, 119, 141, 231 and 407 of SEQ ID NO: 38 are Q12T, Q28M, R77Q, K119R, V141T, A231W and N407G, respectively;
(e) the mutations at amino acid positions 12, 28, 61, 141, 231, and 407 of SEQ ID NO: 38 are Q12R, Q28M, N61L, V141T, A231Y, and N407G, respectively;
(f) the mutations at amino acid positions 12, 28, 119, 231, and 244 of SEQ ID NO: 38 are Q12W, Q28M, K119R, A231Y, and A244R, respectively;
(g) the mutations at amino acid positions 12, 28, 407, and 480 of SEQ ID NO: 38 are Q12W, Q28T, N407G, and I480G, respectively;
(h) the mutations at amino acid positions 12, 141, 231, 413, and 481 of SEQ ID NO: 38 are Q12R, V141T, A231Y, Y413R, and G481I, respectively;
(i) the mutations at amino acid positions 12, 28, 111, 231, and 407 of SEQ ID NO: 38 are Q12T, Q28M, F111A, A231V, and N407G, respectively;
(j) the mutations at amino acid positions 12, 28, 61, 140, and 149 of SEQ ID NO: 38 are Q12T, Q28M, N61L, S140N, and P149R, respectively;

(k) the mutations at amino acid positions 12, 28, 77, 119, 159, 231, 254, 407, and 480 are Q12W, Q28T, R77Q, K119R, V159M, A231Y, R254G, N407G, and I480G, respectively;

(l) the mutations at amino acid positions 12, 28, 254, 309, 407, and 451 of SEQ ID NO: 38 are Q12W, Q28T, R254G, N309S, N407G, and V451M, respectively;

(m) the mutations at amino acid positions 12, 28, 254, 309, 407, and 480 of SEQ ID NO: 38 are Q12W, Q28T, R254G, N309S, N407G, and I480G, respectively; and (n) the mutations at amino acid positions 12, 28, 309, 407, 451, and 480 of SEQ ID NO: 38 are Q12W, Q28T, N309S, N407G, V451M, and I480G, respectively.

5. The CYP153A-reductase hybrid fusion polypeptide variant of claim 1, wherein expression of the CYP153A-reductase hybrid fusion polypeptide variant in a recombinant host cell results in a higher titer of an omega-hydroxylated fatty acid as compared to the titer of an omega-hydroxylated fatty acid produced by expression of the CYP153A-reductase hybrid fusion polypeptide of SEQ ID NO: 6 or SEQ ID NO: 38 in a corresponding host cell.

6. A recombinant host cell expressing the CYP153A-reductase hybrid fusion polypeptide variant of claim 1.

7. The recombinant host cell of claim 6, further expressing a thioesterase polypeptide of EC 3.1.2.-, EC 3.1.1.5 or EC 3.1.2.14.

8. The recombinant host cell of claim 7, wherein the recombinant host cell produces a omega-hydroxylated fatty acid composition with a titer that is at least 10% greater, at least 15% greater, at least 20% greater, at least 25% greater, or at least 30% greater than the titer of an omega-hydroxylated fatty acid composition produced by a host cell expressing a corresponding CYP153A-reductase hybrid fusion polypeptide comprising SEQ ID NO: 38 or SEQ ID NO: 6, when cultured in medium containing a carbon source.

9. A method of producing an omega-hydroxylated fatty acid, comprising: (i) culturing the recombinant host cell of claim 8, the presence of a carbon source.

10. The CYP153A-reductase hybrid fusion polypeptide variant of claim 1, wherein the least one mutation at amino acid position 9 is D9N, or D9K; at amino acid position 10 is D10Y; at amino acid position 11 is I11L; at amino acid position 12 is Q12W, Q12R, or Q12T; at amino acid position 13 is s13K; at amino acid position 14 is R14F; at amino acid position 28 is Q28M, or Q28T; at amino acid position 61 is N61L; at amino acid position 77 is R77Q; at amino acid position 119 is K119R; at amino acid position 159 is V159M; at amino acid position 327 is P327D; at amino acid position 413 is Y413R; at amino acid position 703 is L703G; at amino acid position 745 is P745K, or P745R; at amino acid position 747 is P747N; at amino acid position 749 is E749L, or E749M; at amino acid position 757 is E757A; at amino acid position 770 is T770G; at amino acid position 771 is V771F; or at amino acid position 784 is M784I.

* * * * *